United States Patent
Moore et al.

(10) Patent No.: US 10,316,088 B2
(45) Date of Patent: Jun. 11, 2019

(54) HETERODIMERIC ANTIBODIES THAT BIND SOMATOSTATIN RECEPTOR 2

(71) Applicant: Xencor, Inc., Monrovia, CA (US)

(72) Inventors: Gregory Moore, Azusa, CA (US); Rumana Rashid, Temple City, CA (US); Sung-Hyung Lee, San Gabriel, CA (US); Paul Foster, Rancho Sante Fe, CA (US)

(73) Assignee: Xencor, Inc., Monrovia, CA (US)

( * ) Notice: Subject to any disclaimer, the term of this patent is extended or adjusted under 35 U.S.C. 154(b) by 150 days.

(21) Appl. No.: 15/636,590

(22) Filed: Jun. 28, 2017

(65) Prior Publication Data

US 2018/0118827 A1    May 3, 2018

Related U.S. Application Data

(60) Provisional application No. 62/355,820, filed on Jun. 28, 2016, provisional application No. 62/355,821, filed on Jun. 28, 2016, provisional application No. 62/397,322, filed on Sep. 20, 2016, provisional application No. 62/481,065, filed on Apr. 3, 2017.

(51) Int. Cl.
| | |
|---|---|
| C07K 16/00 | (2006.01) |
| C07K 16/28 | (2006.01) |
| A61P 35/00 | (2006.01) |
| A61K 39/00 | (2006.01) |

(52) U.S. Cl.
CPC .......... *C07K 16/2809* (2013.01); *A61P 35/00* (2018.01); *C07K 16/2869* (2013.01); *A61K 2039/505* (2013.01); *C07K 2317/31* (2013.01); *C07K 2317/52* (2013.01); *C07K 2317/53* (2013.01); *C07K 2317/55* (2013.01); *C07K 2317/56* (2013.01); *C07K 2317/622* (2013.01); *C07K 2317/64* (2013.01); *C07K 2317/73* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell et al. |
| 4,169,888 A | 11/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,364,935 A | 2/1982 | Kung et al. |
| 4,322,348 A | 3/1982 | Asai et al. |
| 4,331,598 A | 5/1982 | Hasegawa et al. |
| 4,361,650 A | 5/1982 | Hasegawa et al. |
| 4,362,663 A | 12/1982 | Kida et al. |
| 4,364,866 A | 12/1982 | Asai et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |

(Continued)

FOREIGN PATENT DOCUMENTS

| | | |
|---|---|---|
| EP | 0425235 B1 | 9/1996 |
| EP | 1752471 | 2/2007 |

(Continued)

OTHER PUBLICATIONS

Muramatsu et al., Production and characterization of an active single-chain variable fragment antibody recognizing CD25., Cancer Lett. Jul. 28, 2005;225(2):225-36. Epub Jan. 23, 2005.

(Continued)

*Primary Examiner* — Sean E Aeder
(74) *Attorney, Agent, or Firm* — Robin M. Silva; Louis T. Nguyen; Morgan, Lewis & Bockius, LLP

(57) ABSTRACT

The present invention is directed to antibodies, including novel antigen binding domains and heterodimeric antibodies, that bind somatostatin receptor 2 (SSTR2).

4 Claims, 135 Drawing Sheets

Specification includes a Sequence Listing.

(56) References Cited

U.S. PATENT DOCUMENTS

| | | |
|---|---|---|
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 4/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winkel |
| 2003/0157108 A1 | 8/2003 | Presta |
| 2003/0223999 A1 | 12/2003 | Lindhofer |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0136485 A1 | 5/2009 | Chu et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Senter |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Senter |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |

(56) References Cited

U.S. PATENT DOCUMENTS

| | | |
|---|---|---|
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |

FOREIGN PATENT DOCUMENTS

| | | |
|---|---|---|
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO2011005621 | 1/2001 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO2007147901 | 12/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2013180201 | 6/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO2011133886 | 10/2010 |
| WO | WO20100112193 | 10/2010 |
| WO | WO2010151792 | 12/2010 |
| WO | WO2010151808 | 12/2010 |
| WO | WO2011036183 | 3/2011 |
| WO | WO2011066342 | 3/2011 |
| WO | WO2011063348 | 5/2011 |
| WO | WO2011066501 | 6/2011 |
| WO | WO2011131746 | 10/2011 |
| WO | WO2011143545 | 11/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2014004586 | 1/2014 |
| WO | WO2014012085 | 1/2014 |
| WO | WO2014056783 | 4/2014 |
| WO | WO2014079000 | 5/2014 |
| WO | WO2014110601 | 7/2014 |

(56) References Cited

FOREIGN PATENT DOCUMENTS

| WO | WO2014113510 | 7/2014 |
|---|---|---|
| WO | WO2014145806 | 9/2014 |
| WO | WO2014145907 | 9/2014 |
| WO | WO2014164553 | 10/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015103072 | 7/2015 |
| WO | WO2015143079 | 9/2015 |
| WO | WO2015149077 | 10/2015 |
| WO | WO2016014984 | 1/2016 |
| WO | WO2016086186 | 6/2016 |
| WO | WO2016086189 | 6/2016 |
| WO | WO2016086196 | 6/2016 |
| WO | WO2016105450 | 6/2016 |

OTHER PUBLICATIONS

Sforzini et al., Targeting of saporin to Hodgkin's lymphoma cells by anti-CD30 and anti-CD25 bispecific antibodies., Br J Haematol. Sep. 1998;102(4):1061-8.
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the Internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., Preparation, properties, and applications of carbohydrate conjugates of proteins and lipids, 1981, CRC Crit. Rev. Biochem., pp. 259-306.
Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bhatt, Sea Lane—DDD presentation, "Surrobodies™—A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
BIOCHEMICA, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann, et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by

(56) References Cited

OTHER PUBLICATIONS elicited macrophages: evidence that oxidation-specific epitopes mediate macrophage recognition., Proc Natl Acad Sci U S A. May 25, 1999;96(11):6353-8.

Chari et al., Immunoconjugates containing novel maytansinoids: promising anticancer drugs, 1992, Cancer Research 52: 127-131.

Chatal, 1989, Monoclonal Antibodies in Immunoscintigraphy, CRC Press (Book Abstract).

Chelius, et al., Structural and functional characterization of the trifunctional antibody catumaxomab, mAbs, 2010, vol. 2, Issue 3, pp. 309-319.

Chothia et al., Canonical structures for the hypervariable regions of immunoglobulins, 1987, J. Mol. Biol. 196:901-917.

Chothia, et al., Structural Determinants in the Sequences of Immunoglobulin Variable Domain, J. Mol. Biol., 1998, vol. 278, pp. 457-479.

Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.

Conrad, et al., TCR and CD3 Antibody Cross-Reactivity in 44 Species, Cytometry Part A, 2007, vol. 71A, pp. 925-933.

Conrath, et al., Antigen Binding and Solubility Effects upon the Veneering of a Camel VHH in Framework-2 to Mimic a VH, J. Mol. Biol., 2005, vol. 350, pp. 112-125.

Counterman et al., "Volumes of Individual Amino Acid Residues in Gas-Phase Peptide Ions.", J. Am. Chem. Soc., 1999, 121 (16), pp. 4031-4039.

Cuesta, et al., Multivalent antibodies: when design surpasses evolution, Trends in Biotechnology, 2010, vol. 28, No. 7, pp. 355-362, doi:10.1016/j.tibtech.2010.03.007.

d'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.

Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.

Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.

Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.

De Groot et al., De-Immunization of Therapeutic Proteins by T-Cell Epitope Modification, 2005, Dev. in Biologicals, 2005, 122:171-194.

De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.

Del Nagro et al., A critical role for complement C3d and the B cell coreceptor (CD19/CD21) complex in the initiation of inflammatory arthritis., J Immunol. Oct. 15, 2005;175(8):5379-89.

Demarest et al., Antibody therapeutics, antibody engineering, and the merits of protein stability, Current Opinin in Drug Discovery & Development, 2008 11(5): 675-587, Sep. 11, 2008.

Deyev, et al., Multivalency: the hallmark of antibodies used for optimization of tumor targeting by design, BioEssays, 2008, vol. 30, pp. 904-918.

DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.

Dixon, et al., Activation of Human T Lymphocytes by Crosslinking of Anti-CD3 Monoclonal Antibodies, Journal of Leukocyte Biology, 1989, vol. 46, pp. 214-220.

Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.

Doronina , Development of potent monoclonal antibody auristatin conjugates for cancer therapy, 2003, Nat Biotechnol 21(7):778-784.

Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.

Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.

Dubowchik et al., Receptor-mediated and enzyme-dependent targeting of cytotoxic anticancer drugs, 1999, Pharm. Therapeutics 83:67-123.

Ducry et al., Antibody-drug conjugates: linking cytotoxic payloads to monoclonal antibodies, 2010, Bioconjugate Chem. 21:5-13.

Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.

Duke, et al., Measurement of apoptosis and other forms of cell death, 2004, Curr protocols immunol. 3.17.1-3.17.16.

DukSin et al., Relationship of the structure and biological activity of the natural homologues of tunicamycin, 1982, J. Biol. Chem. 257:3105.

Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.

Edge et al., Deglycosylation of glycoproteins by trifluoromethanesulfonic acid, 1981, Anal. Biochem. 118:131.

Elliott, et al., Antiparallel Conformation of Knob and Hole Aglycosylated Half-Antibody Homodimers Is Mediated by a CH2-CH3 Hydrophobic Interaction, Journal of Molecular Biology, 2014, vol. 426, Issue 9, pp. 1947-1957.

Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.

Feldmann et al., Retargeting of T Cells to Prostate Stem Cell Antigen Expressing Tumor Cells: Comparison of Different Antibody Formats, Dec. 28, 2010.

Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.

Fischer, Nicolas et al., "Bispecifc antibodies: molecules that enable novel therapeutic strategies", 2007, vol. 74, pp. 3-14.

Foreman, et al., ErbB3 Inhibitory Surrobodies Inhibit Tumor Cell Proliferation In Vitro and In Vivo, Mol Cancer Ther, 2012, vol. 11(7), pp. 1411-1420.

Foreman, et al., PEGS poster, "ErbB3 Inhibitory Surrobodies Inhibit Tumor Cell Proliferation In Vitro and In Vivo," 2012.

Fraker et al., Crystal structure of peptide cyclo-(D-VAL-L-PRO-L-VAL-D-PRO)$_3$, 1978, Biochem. Biophys. Res. Commun. 80(4):849-57.

Francois, et al., Construction of a Bispecific Antibody Reacting with the α-and ß-Chains of the Human IL-2 Receptor, The Journal of Immunology, May 15, 1993, vol. 150, No. 10, pp. 4610-4619.

F-star Modular Antibodies Fact Sheet, Apr. 2008, "Modular Antibody Technology" (w/ reference to Ruker WO 2006/072620 A1).

F-star Modular Antibodies Press Release, Mar. 28, 2008, "Antibody Engineering Company F-Star Buys Back Royalty Obligations. TVM Capital Joins Investor Syndicate."

Fudenberg, et al., Serologic Demonstration of Dual Specificity of Rabbit Bivalent Hybrid Antibody, The Journal of Experimental Medicine, 1964, vol. 119(1), pp. 151-166.

(56) References Cited

OTHER PUBLICATIONS

Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$—Segments in the Preferential Reassociation of Immunoglobulin Subunits, Molecular Immunology, 1986, vol. 23, No. 5, pp. 503-510.
HAwkins et al, Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H$3) which exhibits rapid, high-level targeting of xenografts, 1996, Cancer Res. 56:3055-3061.

Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrornbopoietin receptor agonist single-chain diabody, Protein Engineering, Design & Selection, 2010, vol. 23, No. 8, pp. 667-677.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered . bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci USA. 100(2):639-44.
Kabat et al., 1991, Sequences of proteins of immunological interest, Department of Health and Human Services, Bethesda, vol. 1, 5th Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kipriyanov, et al., Bispecific CD3 x CD19 Diabody for T Cell-Mediated Lysis of Malignant Human B Cells, Int. J. Cancer, 1998. vol. 77, pp. 763-772.

(56) References Cited

OTHER PUBLICATIONS

Kipriyanov, et al., Bispecific Tandem Diabody for Tumor Therapy with Improved Antigen Binding and Pharmacokinetics, J. Mol. Biol., 1999, vol. 293, pp. 41-56.

Kipriyanov, et al., Effect of Domain Order on the Activity of Bacterially Produced Bispecific Single-chain Fv Antibodies, J. Mol. Biol., 2003, vol. 330, pp. 99-111.

Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.

Klein et al., Progression of metastatic human prostate cancer to androgen independence in immunodeficient SDIC mice, 1997, Nature Medicine 3: 402-408.

Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.

Klinger, et al., Immunopharmacologic response of patients with B-lineage acute lymphoblastic leukemia to continuous infusion of T cell—engaging CD19/CD3-bispecific BiTE antibody blinatumomab, Blood, 2012, vol. 119, No. 26, pp. 6226-6233.

Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.

Kostelny, et al., Formation of a Bispecific Antibody by the Use of Leucine Zippers, The Journal of Immunology 1992, vol. 148, pp. 1547-1553.

Krauss et al., Specificity grafting of human antibody frameworks selected from a phage display library: generation of a highly stable humanized anti-CD22 single-chain Fv fragment, 2003, Protein Engineering 16(10):753-759.

Krupka, et al., CD33 target validation and sustained depletion of AML blasts in long-term cultures by the bispecific T-cell—engaging antibody AMG 330, Blood, 2014, vol. 123, No. 3, pp. 356-365, Prepublished online Dec. 3, 2013; doi:10.1182/blood-2013-08-523548 & Data Supplement.

Kung, et al., Monoclonal Antibodies Defining Distinctive Human T Cell Surface Antigens, Science, 1979, vol. 206, pp. 347-349.

Kuppen, peter et al., The development and purification of a bispecific antibody for lymphokine-activated killer cell targeting against the rat colon carcinoma CC531., Cancer Immunol Immunother. Jun. 1993;36(6):403-8.

Labrijn, et al., Efficient generation of stable bispecific IgG1 by controlled Fab-arm exchange, www.pnas.org/cgi/doi/10.1073/pnas.1220145110 & Supporting Information.

Laszlo et al., Cellular determinants for preclinical activity of a novel CD33/CD3 bispecific T-cell engager (BiTE) antibody, AMG 330, against human AML, blood 2014 123: 554-561, Dec. 5, 2013.

Lau et al., Conjugation of Doxorubicin to monoclonal anti-carcinoembryonic antigen antibody via novel thiol-directed cross-linking regents, 1995, Bioorg-Med-Chem. 3(10):1299-1304.

Lau et al., Novel doxorubicin-monoclonal anti-carcinoembryonic antigen antibody immunoconjugate activity in vitro, 1995, Bioorg-Med-Chem. 3(10):1305-12.

Lazar Declaration, Dec. 27, 2010, pp. 1-4.

Lewis, et al., Generation of bispecific IgG antibodies by structure-based design of an orthogonal Fab interface, Nature Biotechnology, 2014, doi:10.1038/nbt.2797 & Supplemental Information.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No, 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu et al., Eradication of large colon tumor xenografts by targeted delivery of maytansinoids, 1996 Proc. Natl. Acad. Sci. USA 93:8618-8623.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Lode et al., Targeted therapy with a novel enediyene antibiotic calicheamicins $o^I_1$ effectively suppress growth and dissemination of liver metastases in a syngeneic model of murine neuroblastoma, 1998, Cancer Res. 58:2928.

Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

Lu, et al., The effect of variable domain orientation and arrangement on the antigen-binding activity of a recombinant human bispecific diabody, Biochemical and Biophysical Research Communications, 2004, vol. 318, pp. 507-513.

Lum, et al., The new face of bispecific antibodies: targeting cancer and much more, Experimental Hematology, 2006, vol. 34, pp. 1-6.

Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.lmmunol, 1996, vol. 43, pp. 134-139.

Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

(56) References Cited

OTHER PUBLICATIONS

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Mandler et al., Modifications in synthesis strategy improve the yield and efficacy of geldanamycin-herceptin immunoconjugates, 2002, Bioconjugate Chem. 13:786-791).
Mandler et al., Synthesis and evaluation of antiproliferative activity of a geldanaymcin-herceptin™ immunoconjugates, 2000, Bioorganic & Med. Chem. Letters 10:1025-1028.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Marks et al., By-passing immunization: building high affinity human antibodies by chain shuffling, 1992, Biotechnology 10:779-783.
Martin, et al., Generation of the Germline Peripheral B Cell Repertoire: VH81X-λ B Cells Are Unable to Complete All Developmental Programs, J. Immunol., 1998, vol. 160, pp. 3748-3758.
Martinez, et al., Characterization of a novel modification on IgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
Mateo et al, Humanization of a mouse nonclonal antibody that blocks the epidermal growth factor receptor: recovery of antagonistic activity, 1997, Immunotechnology, 3(1):71-81.
McPhee, Engineering human immunodeficiency virus 1 protease heterodimers as macromolecular inhibitors of viral maturation, Proc. Natl. Acad. Sci. USA, 1996, vol. 93, pp. 11477-11481.
Meijer, et al., Isolation of Human Antibody Repertoires with Preservation of the Natural Heavy and Light Chain Pairing, J. Mol. Biol., 2006, vol. 358, pp. 764-772.
Merchant, et al., An efficient route to human bispecific IgG, Nature Biotechnology, 1998, vol. 16, pp. 677-681.
Mertens, Nico, "Tribodies: Fab-scFv fusion proteins as a platform to create multi-functional pharmaceuticals.", SpringerLink 2011, 135-149.
Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al, Phase I trial and tumour localization of the anti-EGFR monoclonal antibody ICR62 in head and neck or lung cancer, 1996, Br J Cancer, 73(2):228-35.
Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 1993, 67(2):247-53.
Mølhøj, et al., CD19-/CD3-bispecific antibody of the BiTE class is far superior to tandem diabody with respect to redirected tumor cell lysis, Molecular Immunology 2007, vol. 44 , pp. 1935-1943.
Moore et al., Tuning T Cell Affinity Improves Efficacy and Safety of Anti-CD38 x Anti-CD3 Bispecific Antibodies in Monkeys—A Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.

(56) References Cited

OTHER PUBLICATIONS

Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (-)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein—Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., *J Immunol*. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgeway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al. A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3—Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp. 76-136, 1965, Academic Press.
Senter et al, Proceedings of the American Association for Cancer Research, 2004, vol. 45, Abstract No. 623.
Senter, Potent antibody drug conjugates for cancer therapy, 2009, Current Opin. Chem. Biol. 13:235.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.

(56) References Cited

OTHER PUBLICATIONS

Shan, et al., Characterization of scFv-Ig Constructs Generated from the Anti-CD20 mAb 1F5 Using Linker Peptides of Varying Lengths, J Immunol, 1999, vol. 162, pp. 6589-6595.

Shearman, et al., Construction, Expression and Characterization of Humanized Antibodies Directed Against the Human α/ß T Cell Receptor, The Journal of Immunology, 1991, vol. 147, No. 12, pp. 4366-4373.

Shen, et al., Catumaxomab, a rat/murine hybrid trifunctional bispecific monoclonal antibody for the treatment of cancer, Curr Opin Mol Ther, 2008, vol. 10(3), pp. 273-284.

Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

Shields et al., Lack of fucose on human IgG1 N-linked oligosaccharide improves binding to human FcγRIII and antibody-dependent cellular toxicity, 2002, J Biol Chem 277:26733-26740.

Shier et al., Identification of functional and structural amino-acid residues by parsimonious mutagenesis, 1995, Gene 169:147-155.

Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.

Skehan et al., Identification of functional and structural amino-acid residues by parsimonious mutagenesis, 1990, J. Natl. Cancer Inst. 82(13):1107-12.

Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.

Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Stamova, Unexpected recombinations in single chain bispecific anti-CD3-anti-CD33 antibodies can be avoided by a novel linker module, Oct. 29, 2011.

Stanfield, et al. Maturation of Shark Single-domain (IgNAR) Antibodies: Evidence for Induced-fit Binding, J. Mol. Biol., 2007, vol. 367, pp. 358-372.

Stewart, et al., Recombinant CD36 inhibits oxLDL-induced ICAM-1-dependent monocyte adhesion., Mol Immunol. Feb. 2006;43(3):255-67.

Strop, P. et al., Generating Bispecific Human IgG1 and IgG2 Antibodies from Any Antibody Pair, J. Mol. Biol., 2012, doi:10.1016/j.jmb.2012.04.020.

Tan et al., "Superhumanized" antibodies: reduction of immunogenic potential by complementarity-determining region grafting with human germline sequences: application to an anti-CD28, 2002, J. Immunol. 169:1119-1125.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Tedgui, et al., Cytokines in atherosclerosis: pathogenic and regulatory pathways., Physiol Rev. Apr. 2006;86(2):515-81.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

Thompson, et al., Improved binding of a bivalent single-chain immunotoxin results in increased efficacy for in vivo T-cell depletion, Protein Engineering, 2001, vol. 14, No. 12, pp. 1035-1041.

Thorne, et al., CD36 is a receptor for oxidized high density lipoprotein: implications for the development of atherosclerosis., FEBS Lett. Mar. 20, 2007;581(6):1227-32. Epub Feb. 28, 2007.

Thorpe et al., New coupling agents for the synthesis of immunotoxins containing a hindered disulfide bond with improved stability in Vivo, 1987, Cancer Res. 47:5924-5931.

Thotakura et al., Enzymatic deglycosylating of glycoproteins, 1987, Meth. Enzymol. 138:350.

Thurman et al., Detection of complement activation using monoclonal antibodies against C3d., J Clin Invest. May 2013;123(5):2218-30. doi: 10.1172/JCI65861. Epub Apr. 24, 2013.

Tomlinson et. al., Methods for generating multivalent and bispecific antibody fragments, 2000, Methods Enzymol. 326:461-479.

Topp, et al., Targeted Therapy With the T-Cell—Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.

Traunecker, et al., Bispecific single chain molecules (Janusins) target cytotoxic lymphocytes on HIV infected cells, The EMBO Journal, 1991, vol. 1, No. 12, pp. 3655-3659.

Tsurushita et al., Humanization of monoclonal antibodies, 2004, Molecular Biology of B Cells 533-545.

Umaña et al., Engineered glycoforms of an antineuro-blastoma IgG1 with optimized antibody-dependent cellular cytotoxic activity, 1999, Nat Biotechnol 17:176-180.

Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.

van Boxel, et al., Some lessons from the systematic production and structural analysis of soluble αβ T-cell receptors, Journal of Immunological Methods, 2009, vol. 350, pp. 14-21.

van Wauwe, et al., OKT3: A Monoclonal Anti-Human T Lymphoctye Antibody with Potent Mitogenic Properties, The Journal of Immunology, 1980, vol. 124, No. 6, pp. 2708-2713.

Verdier, et al., Determination of lymphocyte subsets and cytokine levels in Cynomolgus monkeys, Toxicology, 1995, vol. 105, pp. 81-90.

Verhoeyen et al., Reshaping human antibodies: grafting an antilysozyme activity, 1988, Science, 239:1534-1536.

Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.

Vettermann, et al., Powered by pairing: The surrogate light chain amplifies immunoglobulin heavy chain signaling and pre-selects the antibody repertoire, Seminars in Immunology 18, 2006, pp. 44-55.

Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.

Wang et al., Conserved amino acid networks involved in antibody variable domain interactions, Proteins, 2009, vol. 76, pp. 99-114.

Wang et al., Expression and characterization of recombinant soluble monkey CD3 molecules: mapping the FN18 polymorphic epitope, Molecular Immunology, 2004, vol. 40, pp. 1179-1188.

Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.

Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.

Wawrzynczak et al., Methods for preparing immunotoxins: Effect of the linkage on activity and stability. In Immunoconjugates. Anti-

(56) References Cited

OTHER PUBLICATIONS body Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.
Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6, No. 8, pp. 989-995.
Wong, et al., The Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastation 10 derivative auristatin PHE, 2001, Antimicrob. Agents and Chemother. 45(12):3580-3584.
Wu et al, Molectular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.
Wu et al, Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296, pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.
Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zuo, et al., An efficient route to the production of an IgG-like bispecific antibody, Protein Engineering, 2000, vol. 13, No. 5, pp. 361-367.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13/0143.
Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-81376-60CF58B8C06F/CPI_bispecifics.pdf.
Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
Jin et al. The Design and Engineering of IgG-Like Bispecific Antibodies., Chapter 9, Bispecific Antibodies, pp. 151-169.
Zamyatnin AA., Amino Acid, Peptide, and Protein Volume in Solution., Annu Rev Biophys Bioeng. 1984;13:145-65.
Zalevsky et al. "Enhanced antibody half-life improves in vivo activity." Nature Biotechnology, vol. 28, No. 2, Feb. 1, 2010, pp. 157-159.
Ziebig et al., Effect of the oxLDL Binding Protein Fc-CD68 on Plaque Extension and Vulnerability in Atherosclerosis., Circulation Research 108: 695-703, 2011.
Ishigaki et al., Impact of Plasma Oxidized Low-Density Lipoprotein Removal on Atherosclerosis., Circulation 118: 75-83, 2008.
Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38: 313-319. doi:10.1111/j.1365-2222.2007.02896.x.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.
Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

(56) References Cited

OTHER PUBLICATIONS

DiGiandomenico et al., A multifunctional bispecific antibody protects against Pseudomonas aeruginosa., Sci Transl Med. Nov. 12, 2014;6(262):262ra155. doi: 10.1126/scitranslmed.3009655.
U.S. Appl. No. 15/444,087, 2017-0174757, filed Feb. 27, 2017, Jun. 22, 2017.
U.S. Appl. No. 14/207,489, 2014-0377270, filed Mar. 12, 2014, Dec. 25, 2014.
U.S. Appl. No. 15/444,026, 2018-0037668, filed Feb. 27, 2017, Feb. 8, 2018.
U.S. Appl. No. 15/786,252, 2018-0094079, filed Oct. 17, 2017, Apr. 5, 2018.
U.S. Appl. No. 15/141,350, 2016-0355608, filed Apr. 28, 2016, Dec. 8, 2016.
U.S. Appl. No. 14/757,809, 2016-0355600, filed Dec. 22, 2015, Dec. 8, 2016.
U.S. Appl. No. 15/063,441, 2017-0037131, filed Mar. 7, 2016, Feb. 9, 2017.
U.S. Appl. No. 15/372,360, 2017-0320947, filed Dec. 7, 2016, Nov. 9, 2017.
U.S. Appl. No. 15/623,314, 2018-0118836, filed Jun. 14, 2017, May 3, 2018.
U.S. Appl. No. 15/611,361, 2017-0349660, filed Jun. 1, 2017, Dec. 7, 2017.
U.S. Appl. No. 15/611,683, 2017-0349657, filed Jun. 1, 2017, Dec. 7, 2017.
U.S. Appl. No. 15/636,590, 2018-0118827, filed Jun. 28, 2017, May 3, 2018.
U.S. Appl. No. 15/185,958, 2017-0081420, now U.S. Pat. No. 9,850,320, filed Jun. 17, 2016, Mar. 23, 2017, Dec. 26, 2017.
U.S. Appl. No. 15/186,167, 2017-0081424, now U.S. Pat. No. 9,856,327, filed Jun. 17, 2016, Mar. 23, 2017, Jan. 2, 2018.
U.S. Appl. No. 15/691,665, 2018-0127501, filed Aug. 30, 2017, May 10, 2018.
U.S. Appl. No. 15/785,401, 2018-0118805, filed Oct. 16, 2017, May 3, 2018.
U.S. Appl. No. 15/785,393, 2018-0118828, filed Oct. 16, 2017, May 3, 2018.

FIGURE 2

Human SSTR2 sequence

>sp|P30874 (SEQ ID NO: 807)
MDMADEPLNGSHTWLSIPFDLNGSVVSTNTSNQTEPYYDLTSNAVLTFIYFVVCIIGLCGNTL
VIYVILRYAKMKTITNIYILNLAIADELFMLGLPFLAMQVALVHWPFGKAICRVVMTVDGINQ
FTSIFCLTVMSIDRYLAVVHPIKSAKWRRPRTAKMITMAVWGVSLLVILPIMIYAGLRSNQW
GRSSCTINWPGESGAWYTGFIIYTFILGFLVPLTIICLCYLFIIIKVKSSGIRVGSSKRKKSEKKVTR
MVSIVVAVFIFCWLPFYIFNVSSVSMAISPTPALKGMFDFVVVLTYANSCANPILYAFLSDNFK
KSFQNVLCLVKVSGTDDGERSDSKQDKSRLNETTETQRTLLNGDLQTSI

Macaca fascicularis SSTR2 sequence

>gi|544501377|ref|XP_005584875.1 (SEQ ID NO: 808)
MDMVDKPLNGSHTWLSIPFDLNGSVVSTNTSNQTEPYYDLTSNAVLTFIYFVVCIIGLCGNTL
VIYVILRYAKMKTITNIYILNLAIADELFMLGLPFLAMQVALVHWPFGKAICRVVMTVDGINQ
FTSIFCLTVMSIDRYLAVVHPIKSAKWRRPRTAKMITMAVWGVSLLVILPIMIYAGLRSNQW
GRSSCTINWPGESGAWYTGFIIYTFILGFLVPLTIICLCYLFIIIKVKSSGIRVGSSKRKKSEKKVTR
MVSIVVAVFIFCWLPFYIFNVSSVSMAISPTPALKGMFDFVVVLTYANSCANPILYAFLSDNFK
KSFQNVLCLVKVSGTDDGERSDSKQDKSRLNETTETQRTLLNGDLQTSI

FIGURE 3A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

FIGURE 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

FIGURE 3C

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

FIGURE 3D

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

FIGURE 3E

| Monomer 1 | Monomer 2 |
| --- | --- |
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |

FIGURE 3F

| Monomer 1 | Monomer 2 |
|---|---|
| T366S/L368A/Y407V/Y349C | T366W/S354C |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| Q295E N384D Q418E N421D | |
| N208D Q295E Q418E N421D | |
| Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

FIGURE 4

PI VARIANTS

| Variant constant region | Substitutions |
|---|---|
| pI_ISO(-) | I199T N203D K274Q R355Q N384S K392N V397M Q419E DEL447 |
| pI_(-)_isosteric_A | N208D Q295E N384D Q418E N421D |
| pI_(-)_isosteric A-Fc only | Q295E N384D Q418E N421D |
| pI_(-)_isosteric_B | N208D Q295E Q418E N421D |
| pI_(-)_isosteric_B-Fc only | Q295E Q418E N421D |
|  |  |
|  |  |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q |

FIGURE 5

ABLATION VARIANTS

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | 267K/P329K |
| L328E | |
| L328R | |
| P329A | |
| P329H | |

FIGURE 6

| scFv monomer (+) | Fab monomer (-) |
|---|---|
| Heterodimer pI variants S364K/E357Q | Heterodimerization pI variants L368D/K370S |
| Optional scFv charged linker including but not limited to (GKPGS)$_4$ (SEQ ID NO: 55) | Isosteric pI substitutions N208D/Q295E/N384D/Q418E/N421D |
| FcKO E233P/L234V/L235A/G236del/S267K | FcKO E233P/L234V/L235A/G236del/S267K |
| ± 428L/434S for FcRn | ± 428L/434S for FcRn |
| scFv of anti-CD3 | Fv sequences for anti-SSTR2 |

| scFv monomer | Fab monomer |
|---|---|
| Heterodimer pI variants S364K/E357Q | Heterodimerization pI variants L368D/K370S |
| Optional scFv charged linker including, but not limited to (GKPGS)$_4$ (SEQ ID NO: 55) | pI substitutions I199T N203D K274Q R355Q Q419E K447del |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| scFv of anti-CD3 | scFv of anti-SSTR2 |

FIGURE 7A

| Positive charged scFv linkers | | | | |
|---|---|---|---|---|
| Name | Sequence | Length | Charge | SEQ ID NO: |
| Gly-Ser 15 | GGGGSGGGGSGGGGS | 15 | 0 | 809 |
| Whitlow linker | GSTSGSGKPGSGEGSTKG | 18 | +1 | 810 |
| 6paxA_1 (+A) | IRPRAIGGSKPRVA | 14 | +4 | 811 |
| +B | GKGGSGKGGSGKGGS | 15 | +3 | 812 |
| +C | GGKGSGGKGSGGKGS | 15 | +3 | 813 |
| +D | GGGKSGGGKSGGGKS | 15 | +3 | 814 |
| +E | GKGKSGKGKSGKGKS | 15 | +6 | 815 |
| +F | GGGKSGGKGSGKGGS | 15 | +3 | 816 |
| +G | GKPGSGKPGSGKPGS | 15 | +3 | 817 |
| +H | GKPGSGKPGSGKPGSGKPGS | 20 | +4 | 818 |
| +I | GKGKSGKGKSGKGKSGKGKS | 20 | +8 | 819 |
| Negative charged scFv linkers | | | | |
| Name | Sequence | Length | Charge | SEQ ID NO: |
| Gly-Ser 15 | GGGGSGGGGSGGGGSGGGGS | 20 | 0 | 820 |
| 3hsc_2 (-A) | STAGDTHLGGEDFD | 14 | -4 | 821 |
| -B | GEGGSGEGGSGEGGS | 15 | -3 | 822 |
| -C | GGEGSGGEGSGGEGS | 15 | -3 | 823 |
| -D | GGGESGGGESGGGES | 15 | -3 | 824 |
| -E | GEGESGEGESGEGES | 15 | -6 | 825 |
| -F | GGGESGGEGSGEGGS | 15 | -3 | 826 |
| -G | GEGESGEGESGEGESGEGES | 20 | -8 | 827 |

FIGURE 7B scFv Linkers

GGGGSGGGGSGGGGS        (SEQ ID NO: 828)

GGGGSGGGGSGGGGSGGGGS   (SEQ ID NO: 829)

GSTSGSGKPGSGEGSTKG     (SEQ ID NO: 830)

PRGASKSGSASQTGSAPGS    (SEQ ID NO: 831)

GTAAAGAGAAGGAAAGAAG    (SEQ ID NO: 832)

GTSGSSGSGSGGSGSGGGG    (SEQ ID NO: 833)

GKPGSGKPGSGKPGSGKPGS   (SEQ ID NO: 834)

FIGURE 8

| XENP | Heterodimer-skewing variant, Chain 1 | Heterodimer-skewing variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

FIGURE 9A

Bottle opener backbone 1

Fab side heavy chain (SEQ ID NO: 1108)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPI
EKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK
SLSLSPGK scFv heavy chain (SEQ ID NO: 1109)

EPKSSDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK constant light chain (SEQ ID NO: 1110)

RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Bottle opener backbone 2

Fab side heavy chain (SEQ ID NO: 1111)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPI
EKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK
SLSLSPGK scFv heavy chain (SEQ ID NO: 1112)

EPKSSDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKV
SNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

FIGURE 9B

Bottle opener backbone 3

Fab side heavy chain (SEQ ID NO: 1113)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEYNSTYRVVSVLTVLHQDWLNGKEYKCKVSNKALPAPI
EKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQK
SLSLSPGK scFv heavy chain (SEQ ID NO: 1114)

EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKV
SNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Bottle opener backbone 4

Fab side heavy chain (SEQ ID NO: 1115)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEYNSTYRVVSVLTVLHQDWLNGKEYKCKVSNKALPAPI
EKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQ
KSLSLSPGK scFv heavy chain (SEQ ID NO: 1116)

EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKV
SNKALPAPIEKTISKAKGQPREPQVYTLPPSREEMTKNQVSLTCLVKGFYPSDIAVEWESNGQPENNYKTTPPVLDSKGSFFLYSKLEVDKSRWQQGNVFSCSVMHE
ALHNHYTQKSLSLSPGK

FIGURE 9C

Bottle opener backbone 5 (356D/358L allotype)

Fab side heavy chain (SEQ ID NO: 1117)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPI
EKTISKAKGQPREPQVYTLPPSRDELTKNQVSLTCLVKGFYPSDIAVEWESNGQPENNYKTTPPVLDSDGSFFLYSKLTVDKSRWEQGDVFSCSVMHEALHNHYTQK
SLSLSPGK scFv heavy chain (SEQ ID NO: 1118)

EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Bottle opener backbone 6

Fab side heavy chain (SEQ ID NO: 1119)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPI
EKTISKAKGQPREPQVYTLPPSREQMTKNQVSLTCLVKGFYPSDIAVEWESNGQPENNYKTTPPVLDSDGSFFLYSKLTVDKSRWEQGDVFSCSVMHEALHNHYTQK
SLSLSPGK scFv heavy chain (SEQ ID NO: 1120)

EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKV
SNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

FIGURE 9D

Bottle opener backbone 7

Fab side heavy chain (SEQ ID NO: 1121)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSKLTVDKSRWQEGDVFSCSVMHEALHNHYTQK
SLSLSPGK scFv heavy chain (SEQ ID NO: 1122)

EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Bottle opener backbone 8

Fab side heavy chain (SEQ ID NO: 1123)

ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCP
PCPAPEFLGGPSVFLFPPKPKDTLMISRTPEVTCVVVDVKQEDPEVQFNWYVDGVEVHNAKTKPREEEFNSTYRVVSVLTVLHQDWLNGKEYKCKVSNKGLPSSIEK
TISKAKGQPREPQVYTLPPSQEEMTKNQVSLTCDVSGFYPSDIAVEWESDGQPENNYKTTPPVLDSDGSFFLYSKLTVDKSRWEEGDVFSCSVMHEALHNHYTQKSL
SLSLGK scFv heavy chain (SEQ ID NO: 1124)

ESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSN
KGLPSSIEKTISKAKGQPREPQVYTLPPSQEEMTKNQVKLECLVKGFYPSDIAVEWESNGQPENNYKTTPPVLDSDGSFFLYSKLTVDKSRWQEGNVFSCSVMHEAL
HNHYTQKSLSLSLGK

FIGURE 9E

Bottle opener backbone 9

Fab side heavy chain (SEQ ID NO: 1125)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECP
PCPAPPVAGPSVFLFPPKPKDTLMISRTPEVTCVVVDVSHEDPEVQFNWYVDGVEVHNAKTKPREEEFNSTFRVVSLTVVHQDWLNGKEYKCKVSNKGLPAPIEKT
ISKTKGQPREPQVYTLPPSREEMTKNQVSLTCDVSGFYPSDIAVEWESDGQPENNYKTTPPMLDSDGSFFLYSKLTVDKSRWQQGNVFSCSVMHEALHNHYTQKSLS
LSPGK scFv heavy chain (SEQ ID NO: 1126)

ERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNK
GLPAPIEKTISKTKGQPREPQVYTLPPSREQMTKNQVKLECLVKGFYPSDIAVEWESNGQPENNYKTTPPMLDSDGSFFLYSKLTVDKSRWQQGNVFSCSVMHEALH
NHYTQKSLSPGK

Bottle opener backbone 10

Fab side heavy chain (SEQ ID NO: 1127)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECP
PCPAPPVAGPSVFLFPPKPKDTLMISRTPEVTCVVVDVKHEDPEVQFNWYVDGVEVHNAKTKPREEEFNSTFRVVSLTVVHQDWLNGKEYKCKVSNKGLPAPIEKT
ISKTKGQPREPQVYTLPPSREEMTKNQVSLTCDVSGFYPSDIAVEWESDGQPENNYKTTPPMLDSDGSFFLYSKLTVDKSRWQQGNVFSCSVMHEALHNHYTQKSLS
LSPGK scFv heavy chain (SEQ ID NO: 1128)

ERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNK
GLPAPIEKTISKTKGQPREPQVYTLPPSREQMTKNQVKLECLVKGFYPSDIAVEWESNGQPENNYKTTPPMLDSDGSFFLYSKLTVDKSRWQQGNVFSCSVMHEALH
NHYTQKSLSPGK

FIGURE 10A mAb-scFv backbone 1 (356E/358M allotype)

monomer 1 (Fab-scFv side) (SEQ ID NO: 1129)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEYNSTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK monomer 2 (Fab side) (SEQ ID NO: 1130)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPI
EKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQK
SLSLSPGK constant light chain (SEQ ID NO: 1131)

RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 10B mAb-scFv backbone 2

Fab-scFv-Hc - 356D/358L allotype (SEQ ID NO: 1132)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVSNKALPAPI
EKTISKAKGQPREPQVYTLPPSREEMTKNQVSLTCDVSGFYPSDIAVEWESNGQPENNYKTTPPVLDSDGSFFLYSKLTVDKSRWQEGDVFSCSVMHEALHNHYTQK
SLSLSPGK

>mAb-scFv Fab-Hc - 356D/358L allotype (SEQ ID NO: 1133)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTH
TCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPI
EKTISKAKGQPREPQVYTLPPSRDQLTKNQVSLTCLVKGFYPSDIAVEWESNGQPENNYKTTPPVLDSDGSFFLYSKLTVDKSRWQQGNVFSCSVMHEALHNHYTQK
SLSLSPGK mAb-scFv backbone 3

>mAb-scFv Fab-scFv-Hc - N297A (SEQ ID NO: 1134)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEEYASTYRVVSVLTVLHQDWLNGKEYKCKVSNKALPAPI
EKTISKAKGQPREPQVYTLPPSREEMTKNQVSLTCDVSGFYPSDIAVEWESDGQPENNYKTTPPVLDSDGSFFLYSKLTVDKSRWQEGDVFSCSVMHEALHNHYTQK
SLSLSPGK

>mAb-scFv Fab-Hc - N297A (SEQ ID NO: 1135)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTH
TCPPCPAPPVAGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPI
EKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQK
SLSLSPGK

FIGURE 10C mAb-scFv backbone 4

>mAb-scFv Fab-scFv-Hc - N297S (SEQ ID NO: 1136)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTH
TCPPCPAPPVAGPSVFLFPPKPKDTLMISRTPEVTCVVVDVSHEDPEVKFNWYVDGVEVHNAKTKPREEEYSSTYRVVSVLTVLHQDWLNGKEYKCKVSNKALPAPI
EKTISKAKGQPREPQVYTLPPSREEMTKNQVSLTCDVSGFYPSDIAVEWESNGQPENNYKTTPPVLDSDGSFFLYSKLTVDKSRWEQGDVFSCSVMHEALHNHYTQK
SLSLSPGK

>mAb-scFv Fab-Hc - N297S (SEQ ID NO: 1137)

ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTH
TCPPCPAPPVAGPSVFLFPPKPKDTLMISRTPEVTCVVVDVSHEDPEVKFNWYVDGVEVHNAKTKPREEQYSSTYRVVSVLTVLHQDWLNGKEYKCKVSNKALPAPI
EKTISKAKGQPREPQVYTLPPSREQMTKNQVSLTCDVSGFYPSDIAVEWESNGQPENNYKTTPPVLDSDGSFFLYSKLTVDKSRWQQGNVFSCSVMHEALHNHYTQK
SLSLSPGK mAb-scFv backbone 5

>mAb-scFv Fab-scFv-IgG4-Hc (SEQ ID NO: 1138)

ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCP
PCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEK
TISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSL
SLSLGK

>mAb-scFv Fab-IgG4-Hc (SEQ ID NO: 1139)

ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCP
PCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEK
TISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSL
SLSLGK

FIGURE 10D mAb-scFv backbone 6

>mAb-scFv Fab-scFv-IgG2-Hc -- without S267K (SEQ ID NO: 1140)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECP
PCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKT
ISKTKGQPREPQVYTLPPSREEMTKNQVSLTCDVSGFFLYSKLTVDKSRWQQGDVFSCSVMHEALHNHYTQKSLS
LSPGK

>mAb-scFv Fab-IgG2-Hc -- without S267K (SEQ ID NO: 1141)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECP
PCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKT
ISKTKGQPREPQVYTLPPSREEMTKNQVSLTCDVSGFFLYSKLTVDKSRWQQGNVFSCSVMHEALHNHYTQKSLS
LSPGK mAb-scFv backbone 7

>mAb-scFv Fab-scFv-IgG2-Hc -- with S267K (SEQ ID NO: 1142)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECP
PCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKT
ISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLS
LSPGK

>mAb-scFv Fab-IgG2-Hc -- with S267K (SEQ ID NO: 1143)

ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECP
PCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKT
ISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLS
LSPGK

FIGURE 11A

| XENP019583 Anti-SSTR2_H1.143_L1.30 | Sequence | SEQ ID NO: |
|---|---|---|
| Variable heavy (vh) domain | EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDPMDYWGQGTLVTVS | 958 |
| vhCDR1 | DYGMA | 959 |
| vhCDR2 | FISNLGYSIYYADSVKG | 960 |
| vhCDR3 | APYDYDSFDPMDY | 961 |
| Variable light (vl) domain | DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKVEIK | 962 |
| vlCDR1 | KSSQSLLNSRNRKNYLA | 963 |
| vlCDR2 | WASTRES | 964 |
| vlCDR3 | KQSYYLWT | 965 |

| XENP016452 Anti-SSTR2_H1_L1.1 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYPMDYWGQGTLVTVSS | 966 |
| vhCDR1 | DYGMA | 967 |
| vhCDR2 | FISNLAYSIYYADSVKG | 968 |
| vhCDR3 | APYDYDSFYPMDY | 969 |
| Variable light (vl) domain | DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVEIK | 970 |
| vlCDR1 | KSSQSLLNSRTRKNYLA | 971 |
| vlCDR2 | WASTRES | 972 |
| vlCDR3 | KQSYYLWT | 973 |

FIGURE 11B

| XENP017795 Anti-SSTR2_H1.107_L1.30 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLAYSIYYADSVKGRFTISRDNA KNSLYLQMNSLRAEDTAVYYCARAPYDYDSFDPMDYWGQGTLVTVSS | 974 |
| vhCDR1 | DYGMA | 975 |
| vhCDR2 | FISNLAYSIYYADSVKG | 976 |
| vhCDR3 | APYDYDSFDPMDY | 977 |
| Variable light (vl) domain | DIVMTQSPDSLAVSLGERATINCKSSQSLLNSRNRKNYLAWYQQKPDQSPKLLIYWASTRESGVPDRFSGSGSGTD FTLTISSLQAEDVAVYYCKQSYYLWTFGGGTKVEIK | 978 |
| vlCDR1 | KSSQSLLNSRNRKNYLA | 979 |
| vlCDR2 | WASTRES | 980 |
| vlCDR3 | KQSYYLWT | 981 |

| XENP017801 Anti-SSTR2_H1.107_L1.67 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLAYSIYYADSVKGRFTISRDNA KNSLYLQMNSLRAEDTAVYYCARAPYDYDSFDPMDYWGQGTLVTVSS | 982 |
| vhCDR1 | DYGMA | 983 |
| vhCDR2 | FISNLAYSIYYADSVKG | 984 |
| vhCDR3 | APYDYDSFDPMDY | 985 |
| Variable light (vl) domain | DIVMTQSPDSLAVSLGERATINCKSSQSLLNSRTRKNYLAWYQQKPDQSPKLLIYWASTRASGVPDRFSGSGSGTD FTLTISSLQAEDVAVYYCKQSYYLWTFGGGTKVEIK | 986 |
| vlCDR1 | KSSQSLLNSRTRKNYLA | 987 |
| vlCDR2 | WASTRAS | 988 |
| vlCDR3 | KQSYYLWT | 989 |

FIGURE 11C

| XENP018037<br>Anti-SSTR2_H1.07_L1.108 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLAYSIYYADSVKGRFTISRDNA KNSLYLQMNSLRAEDTAVYYCARAPYDYDSFDPMDYWGQGTLVTVSS | 990 |
| vhCDR1 | DYGMA | 991 |
| vhCDR2 | FISNLAYSIYYADSVKG | 992 |
| vhCDR3 | APYDYDSFDPMDY | 993 |
| Variable light (vl) domain | DIVMTQSPDSLAVSLGERATINCKSSQSLLNSRNRKSYLAWYQQKPDQSPKLLIYYASTRASGVPDRFSGSGSGTDF TLTISSLQAEDVAVYYCKQSYYLWTFGGGTKVEIK | 994 |
| vlCDR1 | KSSQSLLNSRNRKSYLA | 995 |
| vlCDR2 | YASTRAS | 996 |
| vlCDR3 | KQSYYLWT | 997 |

| XENP018038<br>Anti-SSTR2_H1.107_L1.111 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLAYSIYYADSVKGRFTISRDNA KNSLYLQMNSLRAEDTAVYYCARAPYDYDSFDPMDYWGQGTLVTVSS | 998 |
| vhCDR1 | DYGMA | 999 |
| vhCDR2 | FISNLAYSIYYADSVKG | 1000 |
| vhCDR3 | APYDYDSFDPMDY | 1001 |
| Variable light (vl) domain | DIVMTQSPDSLAVSLGERATINCKSSQSLLNSRNRKSYLAWYQQKPDQSPKLLIYYASTRASGVPDRFSGSGSGTDF TLTISSLQAEDVAVYYCKQSYYLWTFGGGTKVEIK | 1002 |
| vlCDR1 | KSSQSLLNSRNRKSYLA | 1003 |
| vlCDR2 | YASTRAS | 1004 |
| vlCDR3 | KQSYYLWT | 1005 |

FIGURE 11D

| XENP018039<br>Anti-SSTR2_H1.107_L1.114 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLAYSIYYADSVKGRFTISRDNA<br>KNSLYLQMNSLRAEDTAVYYCARAPYDYDSFDPMDYWGQGTLVTVSS | 1006 |
| vhCDR1 | DYGMA | 1007 |
| vhCDR2 | FISNLAYSIYYADSVKG | 1008 |
| vhCDR3 | APYDYDSFDPMDY | 1009 |
| Variable light (vl) domain | DIVMTQSPDSLAVSLGERATINCKSSQSLLNSRNRKSYLAWYQQKPDQSPKLLIYYASTRASGVPDRFSGSGSGTDF<br>TLTISSLQAEDVAVYYCKQSYYLWTFGGGTKVEIK | 1010 |
| vlCDR1 | KSSQSLLNSRNRKSYLA | 1011 |
| vlCDR2 | YASTRAS | 1012 |
| vlCDR3 | KQSYYLWT | 1013 |

| XENP018061<br>Anti-SSTR2_H1.107_L1.X102 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLAYSIYYADSVKGRFTISRDNA<br>KNSLYLQMNSLRAEDTAVYYCARAPYDYDSFDPMDYWGQGTLVTVSS | 1014 |
| vhCDR1 | DYGMA | 1015 |
| vhCDR2 | FISNLAYSIYYADSVKG | 1016 |
| vhCDR3 | APYDYDSFDPMDY | 1017 |
| Variable light (vl) domain | DIVMTQSPDSLAVSLGERATINCKSSQSLLNSRNRKSYLAWYQQKPDQSPKLLIYYASTRASGVPDRFSGSGSGTDF<br>TLTISSLQAEDVAVYYCKQSYYLWTFGGGTKVEIK | 1018 |
| vlCDR1 | KSSQSLLNSRNRKSYLA | 1019 |
| vlCDR2 | YASTRAS | 1020 |
| vlCDR3 | KQSYYLWT | 1021 |

FIGURE 11E

| XENP018040<br>Anti-SSTR2_H1.125_L1.30 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLGYSIYYADSVKGRFTISRDNA<br>KNSLYLQMNSLRAEDTAVYYCARAPYDYDSFDPMDYWGQGTLVTVSS | 1022 |
| vhCDR1 | DYGMA | 1023 |
| vhCDR2 | FISNLGYSIYYADSVKG | 1024 |
| vhCDR3 | APYDYDSFDPMDY | 1025 |
| Variable light (vl) domain | DIVMTQSPDSLAVSLGERATINCKSSQSLLNSRNRKNYLAWYQQKPDQSPKLLIYWASTRESGVPDRFSGSGSGTD<br>FTLTISSLQAEDVAVYYCKQSYYLWTFGGGTKVEIK | 1026 |
| vlCDR1 | KSSQSLLNSRNRKNYLA | 1027 |
| vlCDR2 | WASTRES | 1028 |
| vlCDR3 | KQSYYLWT | 1029 |

| XENP018060<br>Anti-SSTR2_H1.125_L1.67 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLGYSIYYADSVKGRFTISRDNA<br>KNSLYLQMNSLRAEDTAVYYCARAPYDYDSFDPMDYWGQGTLVTVSS | 1030 |
| vhCDR1 | DYGMA | 1031 |
| vhCDR2 | FISNLGYSIYYADSVKG | 1032 |
| vhCDR3 | APYDYDSFDPMDY | 1033 |
| Variable light (vl) domain | DIVMTQSPDSLAVSLGERATINCKSSQSLLNSRTRKNYLAWYQQKPDQSPKLLIYWASTRASGVPDRFSGSGSGTD<br>FTLTISSLQAEDVAVYYCKQSYYLWTFGGGTKVEIK | 1034 |
| vlCDR1 | KSSQSLLNSRTRKNYLA | 1035 |
| vlCDR2 | WASTRAS | 1036 |
| vlCDR3 | KQSYYLWT | 1037 |

FIGURE 11F

| XENP018041<br>Anti-SSTR2_H1.125_L1.108 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLGYSIYYADSVKGRFTISRDNA KNSLYLQMNSLRAEDTAVYYCARAPYDYDSFDPMDYWGQGTLVTVSS | 1038 |
| vhCDR1 | DYGMA | 1039 |
| vhCDR2 | FISNLGYSIYYADSVKG | 1040 |
| vhCDR3 | APYDYDSFDPMDY | 1041 |
| Variable light (vl) domain | DIVMTQSPDSLAVSLGERATINCKSSQSLLNSRNRKSYLAWYQQKPDQSPKLLIYYASTRASGVPDRFSGSGSGTDF TLTISSLQAEDVAVYYCKQSYYLWTFGGGTKVEIK | 1042 |
| vlCDR1 | KSSQSLLNSRNRKSYLA | 1043 |
| vlCDR2 | YASTRAS | 1044 |
| vlCDR3 | KQSYYLWT | 1045 |

| XENP018042<br>Anti-SSTR2_H1.125_L1.111 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLGYSIYYADSVKGRFTISRDNA KNSLYLQMNSLRAEDTAVYYCARAPYDYDSFDPMDYWGQGTLVTVSS | 1046 |
| vhCDR1 | DYGMA | 1047 |
| vhCDR2 | FISNLGYSIYYADSVKG | 1048 |
| vhCDR3 | APYDYDSFDPMDY | 1049 |
| Variable light (vl) domain | DIVMTQSPDSLAVSLGERATINCKSSQSLLNSRNRKSYLAWYQQKPDQSPKLLIYYASTRASGVPDRFSGSGSGTDF TLTISSLQAEDVAVYYCKQSYYLWTFGGGTKVEIK | 1050 |
| vlCDR1 | KSSQSLLNSRNRKSYLA | 1051 |
| vlCDR2 | YASTRAS | 1052 |
| vlCDR3 | KQSYYLWT | 1053 |

FIGURE 11G

| XENP018043 Anti-SSTR2_H1.125_L1.114 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLGYSIYYADSVKGRFTISRDNA KNSLYLQMNSLRAEDTAVYYCARAPYDYDSFDPMDYWGQGTLVTVSS | 1054 |
| vhCDR1 | DYGMA | 1055 |
| vhCDR2 | FISNLGYSIYYADSVKG | 1056 |
| vhCDR3 | APYDYDSFDPMDY | 1057 |
| Variable light (vl) domain | DIVMTQSPDSLAVSLGERATINCKSSQSLLNSRNRKSYLAWYQQKPDQSPKLLIYYASTRASGVPDRFSGSGSGTDF TLTISSLQAEDVAVYYCKQSYYLWTFGGGTKVEIK | 1058 |
| vlCDR1 | KSSQSLLNSRNRKSYLA | 1059 |
| vlCDR2 | YASTRAS | 1060 |
| vlCDR3 | KQSYYLWT | 1061 |

| XENP018062 Anti-SSTR2_H1.125_L1.102 | Sequence | SEQ ID NO: |
|---|---|---|
| Variable heavy (vh) domain | EVQLVESGGGLVQPGGSLRLSCAASGFTFSDYGMAWFRQAPGKGPEWVSFISNLGYSIYYADSVKGRFTISRDNA KNSLYLQMNSLRAEDTAVYYCARAPYDYDSFDPMDYWGQGTLVTVSS | 1062 |
| vhCDR1 | DYGMA | 1063 |
| vhCDR2 | FISNLGYSIYYADSVKG | 1064 |
| vhCDR3 | APYDYDSFDPMDY | 1065 |
| Variable light (vl) domain | DIVMTQSPDSLAVSLGERATINCKSSQSLLNSRNRKSYLAWYQQKPDQSPKLLIYYASTRASGVPDRFSGSGSGTDF TLTISSLQAEDVAVYYCKQSYYLWTFGGGTKVEIK | 1066 |
| vlCDR1 | KSSQSLLNSRNRKSYLA | 1067 |
| vlCDR2 | YASTRAS | 1068 |
| vlCDR3 | KQSYYLWT | 1069 |

FIGURE 12A

High CD3: Anti-CD3_H1.30_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLY LQMNSLRAEDTAVYYCVRHGNFGDSYVSWFAYWGQGTLVTVSS | 1 |
| vhCDR1 | TYAMN | 2 |
| vhCDR2 | RIRSKYNNYATYYADSVKG | 3 |
| vhCDR3 | HGNFGDSYVSWFAY | 4 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPE DEADYYCALWYSNHWVFGGGTKLTVL | 5 |
| vlCDR1 | GSSTGAVTTSNYAN | 6 |
| vlCDR2 | GTNKRAP | 7 |
| vlCDR3 | ALWYSNHWV | 8 |
| scFv (including charged linker) | EVQLVESGGGLVQPGGSLRLSCAASGFTFSTYAMNWVRQAPGKGLEWVGRIRSKYNNYATYYADSVKGRFTISRDDSKNTLY LQMNSLRAEDTAVYYCVRHGNFGDSYVSWFAYWGQGTLVTVSSGKPGSGKPGSGKPGSGKPGSQAVVTQEPSLTVSPGGT VTLTCGSSTGAVTTSNYANWVQQKPGKSPRGLIGGTNKRAPGVPARFSGSLLGGKAALTISGAQPEDEADYYCALWYSNHW VFGGGTKLTVL | 9 |

FIGURE 12B

High-Int #1 CD3: Anti-CD3_H1.32_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKANNYATYYADSVKGRFTISRDDSKNTLY LQMNSLRAEDTAVYYCVRHGNFGDSYVSWFAYWGQGTLVTVSS | 10 |
| vhCDR1 | TYAMN | 11 |
| vhCDR2 | RIRSKANNYATYYADSVKG | 12 |
| vhCDR3 | HGNFGDSYVSWFAY | 13 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPE DEADYYCALWYSNHWVFGGGTKLTVL | 14 |
| vlCDR1 | GSSTGAVTTSNYAN | 15 |
| vlCDR2 | GTNKRAP | 16 |
| vlCDR3 | ALWYSNHWV | 17 |
| scFv (including charged linker) | EVQLVESGGGLVQPGGSLRLSCAASGFTFSTYAMNWVRQAPGKGLEWVGRIRSKANNYATYYADSVKGRFTISRDDSKNTLY LQMNSLRAEDTAVYYCVRHGNFGDSYVSWFAYWGQGTLVTVSSGKPGSGKPGSGKPGSQAVVTQEPSLTVSPGGT VTLTCGSSTGAVTTSNYANWVQQKPGKSPRGLIGGTNKRAPGVPARFSGSLLGGKAALTISGAQPEDEADYYCALWYSNHW VFGGGTKLTVL | 18 |

FIGURE 12C

High-Int #2 CD3: Anti-CD3_H1.89_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLY LQMNSLRAEDTAVYYCVRHGNFGDEYVSWFAYWGQGTLVTVSS | 19 |
| vhCDR1 | TYAMN | 20 |
| vhCDR2 | RIRSKYNNYATYYADSVKG | 21 |
| vhCDR3 | HGNFGDEYVSWFAY | 22 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPE DEADYYCALWYSNHWVFGGGTKLTVL | 23 |
| vlCDR1 | GSSTGAVTTSNYAN | 24 |
| vlCDR2 | GTNKRAP | 25 |
| vlCDR3 | ALWYSNHWV | 26 |
| scFv (including charged linker) | EVQLVESGGGLVQPGGSLRLSCAASGFTFSTYAMNWVRQAPGKGLEWVGRIRSKYNNYATYYADSVKGRFTISRDDSKNTLY LQMNSLRAEDTAVYYCVRHGNFGDEYVSWFAYWGQGTLVTVSSGGKPGSGKPGSGKPGSQAVVTQEPSLTVSPGGT VTLTCGSSTGAVTTSNYANWVQQKPGKSPRGLIGGTNKRAPGVPARFSGSLLGGKAALTISGAQPEDEADYYCALWYSNHW VFGGGTKLTVL | 27 |

FIGURE 12D

High-Int #3 CD3: Anti-CD3_H1.90_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLY LQMNSLRAEDTAVYYCVRHGNFGDPYVSWFAYWGQGTLVTVSS | 28 |
| vhCDR1 | TYAMN | 29 |
| vhCDR2 | RIRSKYNNYATYYADSVKG | 30 |
| vhCDR3 | HGNFGDPYVSWFAY | 31 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPE DEADYYCALWYSNHWVFGGGTKLTVL | 32 |
| vlCDR1 | GSSTGAVTTSNYAN | 33 |
| vlCDR2 | GTNKRAP | 34 |
| vlCDR3 | ALWYSNHWV | 35 |
| scFv (including charged linker) | EVQLVESGGGLVQPGGSLRLSCAASGFTFSTYAMNWVRQAPGKGLEWVGRIRSKYNNYATYYADSVKGRFTISRDDSKNTLY LQMNSLRAEDTAVYYCVRHGNFGDPYVSWFAYWGQGTLVTVSSGKPGSGKPGSGKPGSGKPGSQAVVTQEPSLTVSPGGT VTLTCGSSTGAVTTSNYANWVQQKPGKSPRGLIGGTNKRAPGVPARFSGSLLGGKAALTISGAQPEDEADYYCALWYSNHW VFGGGTKLTVL | 36 |

FIGURE 12E

Intermediate CD3: Anti-CD3_H1.33_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | 37 |
| vhCDR1 | TYAMN | 38 |
| vhCDR2 | RIRSKYNNYATYYADSVKG | 39 |
| vhCDR3 | HGNFGDSYVSWFDY | 40 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 41 |
| vlCDR1 | GSSTGAVTTSNYAN | 42 |
| vlCDR2 | GTNKRAP | 43 |
| vlCDR3 | ALWYSNHWV | 44 |
| scFv (including charged linker) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSSGKPGSSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 45 |

FIGURE 12F

Low CD3: Anti-CD3_H1.31_L1.47

| What | sequence | SEQ ID NO: |
|---|---|---|
| Variable heavy (vh) domain | EVQLVESGGGLVQPGGSLRLSCAASGFTFSTYAMSWVRQAPGKGLEWVGRIRSKYNNYATYYADSVKGRFTISRDDSKNTLYL QMNSLRAEDTAVYYCVRHGNFGDSYVSWFAYWGQGTLVTVSS | 46 |
| vhCDR1 | TYAMS | 47 |
| vhCDR2 | RIRSKYNNYATYYADSVKG | 48 |
| vhCDR3 | HGNFGDSYVSWFAY | 49 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPE DEADYYCALWYSNHWVFGGGTKLTVL | 50 |
| vlCDR1 | GSSTGAVTTSNYAN | 51 |
| vlCDR2 | GTNKRAP | 52 |
| vlCDR3 | ALWYSNHWV | 53 |
| scFv (including charged linker) | EVQLVESGGGLVQPGGSLRLSCAASGFTFSTYAMSWVRQAPGKGLEWVGRIRSKYNNYATYYADSVKGRFTISRDDSKNTLYL QMNSLRAEDTAVYYCVRHGNFGDSYVSWFAYWGQGTLVTVSSGKPGSGKPGSGKPGSGKPGSQAVVTQEPSLTVSPGGTV TLTCGSSTGAVTTSNYANWVQQKPGKSPRGLIGGTNKRAPGVPARFSGSLLGGKAALTISGAQPEDEADYYCALWYSNHWV FGGGTKLTVL | 54 |

FIGURE 13A

Anti-CD3 sequences

H1_L1.4

SEQ ID NO: 835

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 836

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 837

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS

SEQ ID NO: 838

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 839

EVQLVESGGGLVQPGGSLRLSCAASGFTFS<u>TYAMN</u>WVRQAPGKGLEWVGR<u>IRSKYNNYATYYADSVKG</u>RFTISRDDS
KNTLYLQMNSLRAEDTAVYYCVR<u>HGNFGDSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 840

EVQLVESGGGLVQPGGSLRLSCAASGFTFS<u>TYAMN</u>WVRQAPGKGLEWVGR<u>IRSKYNNYATYYADSVKG</u>RFTISRDDS
KNTLYLQMNSLRAEDTAVYYCVR<u>HGNFGDSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 841

EVQLVESGGGLVQPGGSLRLSCAASGFTFS<u>TYAMN</u>WVRQAPGKGLEWVGR<u>IRSKYNNYATYYADSVKG</u>RFTISRDDS
KNTLYLQMNSLRAEDTAVYYCVR<u>HGNFGDSYVSWFAY</u>WGQGTLVTVSS

SEQ ID NO: 842

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 843

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDSYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 844

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDSYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 845

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDSYVSWFDY</u>WGQGTLVTVSS

SEQ ID NO: 846

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 847

EVQLVESGGGLVQPGGSLRLSCAASGFTFSTYAMSWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 848

EVQLVESGGGLVQPGGSLRLSCAASGFTFSTYAMSWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 849

EVQLVESGGGLVQPGGSLRLSCAASGFTFSTYAMSWVRQAPGKGLEWVGRIRSKYNNYATYYADSVKGRFTISRDDS
KNTLYLQMNSLRAEDTAVYYCVRHGNFGDSYVSWFAYWGQGTLVTVSS

SEQ ID NO: 850

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 851

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 852

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 853

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFAY</u>WGQGTLVTVSS

SEQ ID NO: 854

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 855

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGPSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 856

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGPSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 857

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGPSYVSWFAY</u>WGQGTLVTVSS

SEQ ID NO: 858

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 859

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 860

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 861

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFAYWGQGTLVTVSS

SEQ ID NO: 862

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 863

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDPYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 864

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDPYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 865

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDPYVSWFAYWGQGTLVTVSS

SEQ ID NO: 866

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 867

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 868

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 869

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFAY</u>WGQGTLVTVSS

SEQ ID NO: 870

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 871

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 872

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 873

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFAYWGQGTLVTVSS

SEQ ID NO: 874

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 875

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGESYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 876

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGESYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 877

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGESYVSWFAYWGQGTLVTVSS

SEQ ID NO: 878

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 879

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGQSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 880

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGQSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 881

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGQSYVSWFAYWGQGTLVTVSS

SEQ ID NO: 882

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 883

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDNYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 884

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDNYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 885

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDNYVSWFAY</u>WGQGTLVTVSS

SEQ ID NO: 886

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 887

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDQYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 888

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDQYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 889

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDQYVSWFAY</u>WGQGTLVTVSS

SEQ ID NO: 890

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 891

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLI<u>GGTNKRAP</u>GVPARFSGSLLGGKAALTISGAQPEDE
ADYYC<u>ALWYSNHWV</u>FGGGTKLTVLGSHHHHHH

SEQ ID NO: 892

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLI<u>GGTNKRAP</u>GVPARFSGSLLGGKAALTISGAQPEDE
ADYYC<u>ALWYSNHWV</u>FGGGTKLTVL

SEQ ID NO: 893

EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVR<u>HGNFGDSYVSWFDY</u>WGQGTLVTVSS

SEQ ID NO: 894

QAVVTQEPSLTVSPGGTVTLTC<u>GSSTGAVTTSNYAN</u>WVQQKPGKSPRGLI<u>GGTNKRAP</u>GVPARFSGSLLGGKAALTIS
GAQPEDEADYYC<u>ALWYSNHWV</u>FGGGTKLTVL

SEQ ID NO: 895

EVQLVESGGGLVQPGGSLRLSCAASGFTFS<u>TYAMN</u>WVRQAPGKGLEWVG<u>RIRSKYNNYATAYADSVKG</u>RFTISRDDS
KNTLYLQMNSLRAEDTAVYYCVR<u>HGNFGDSYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 896

EVQLVESGGGLVQPGGSLRLSCAASGFTFS<u>TYAMN</u>WVRQAPGKGLEWVG<u>RIRSKYNNYATAYADSVKG</u>RFTISRDDS
KNTLYLQMNSLRAEDTAVYYCVR<u>HGNFGDSYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 897

EVQLVESGGGLVQPGGSLRLSCAASGFTFS<u>TYAMN</u>WVRQAPGKGLEWVG<u>RIRSKYNNYATAYADSVKG</u>RFTISRDDS
KNTLYLQMNSLRAEDTAVYYCVR<u>HGNFGDSYVSWFDY</u>WGQGTLVTVSS

SEQ ID NO: 898

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 899

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGASYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 900

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGASYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 901

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGASYVSWFDY</u>WGQGTLVTVSS

SEQ ID NO: 902

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 903

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGQSYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 904

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGQSYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 905

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGQSYVSWFDYWGQGTLVTVSS

SEQ ID NO: 906

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 907

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 908

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 909

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFDYWGQGTLVTVSS

SEQ ID NO: 910

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 911

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 912

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 913

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFDYWGQGTLVTVSS

SEQ ID NO: 914

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 915

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDPYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 916

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDPYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 917

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDPYVSWFDY</u>WGQGTLVTVSS

SEQ ID NO: 918

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 919

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDQYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 920

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDQYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 921

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDQYVSWFDYWGQGTLVTVSS

SEQ ID NO: 922

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 923

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVLGSHHHHHH

SEQ ID NO: 924

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVL

SEQ ID NO: 925

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFAY</u>WGQGTLVTVSS

SEQ ID NO: 926

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 927

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGASYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVLGSHHHHHH

SEQ ID NO: 928

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGASYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVL

SEQ ID NO: 929

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGASYVSWFAY</u>WGQGTLVTVSS

SEQ ID NO: 930

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 931

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGQSYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVLGSHHHHHH

SEQ ID NO: 932

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGQSYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVL

SEQ ID NO: 933

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGQSYVSWFAY</u>WGQGTLVTVSS

SEQ ID NO: 934

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 935

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFD</u>YWGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVLGSHHHHHH

SEQ ID NO: 936

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFD</u>YWGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVL

SEQ ID NO: 937

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFD</u>YWGQGTLVTVSS

SEQ ID NO: 938

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

FIGURE 14A

XENP18087

>XENP018087 Anti-SSTR2 (H1.143_L1.30) x Anti-CD3 (H1.30_L1.47) SSTR2 Fab-Fc Heavy Chain SEQ ID NO: 1070
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYSEDPMDYWGQGTLVTVSS/ASTKGPSVF
PLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPV
LDSDGSFFLYSKLTVDKSRWQQGDVFSCSVMHEALHNHYTQKSLSLSPGK >XENP018087 Anti-SSTR2 (H1.143_L1.30) x Anti-CD3 (H1.30_L1.47) SSTR2 Fab variable heavy chain SEQ ID NO: 1071
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYSEDPMDYWGQGTLVTVSS >XENP018087 Anti-SSTR2 (H1.143_L1.30) x Anti-CD3 (H1.30_L1.47) SSTR2 Fab vhCDR1 SEQ ID NO: 1072
DYGMA >XENP018087 Anti-SSTR2 (H1.143_L1.30) x Anti-CD3 (H1.30_L1.47) SSTR2 Fab vhCDR2 SEQ ID NO: 1073
FISNLGYSIYYADSVKG >XENP018087 Anti-SSTR2 (H1.143_L1.30) x Anti-CD3 (H1.30_L1.47) SSTR2 Fab vhCDR3 SEQ ID NO: 1074
APYDYSEDPMDY >XENP018087 Anti-SSTR2 (H1.143_L1.30) x Anti-CD3 (H1.30_L1.47) SSTR2 Light Chain SEQ ID NO: 1075
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKVEIK/RTVAAPSVFIFPPSDEQLKSGTA
SVVCLLNNFYPREAKVQWKVDNALQSGNSQESVTEQDSKDSTYSLSSTLTLSKADYEKHKVYACEVTHQGLSSPVTKSFNRGEC >XENP018087 Anti-SSTR2 (H1.143_L1.30) x Anti-CD3 (H1.30_L1.47) SSTR2 variable light chain SEQ ID NO: 1076
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKVEIK >XENP018087 Anti-SSTR2 (H1.143_L1.30) x Anti-CD3 (H1.30_L1.47) SSTR2 vlCDR1 SEQ ID NO: 1077
KSSQSLLNSRNRKNYLA >XENP018087 Anti-SSTR2 (H1.143_L1.30) x Anti-CD3 (H1.30_L1.47) SSTR2 vlCDR2 SEQ ID NO: 1078
WASTRES >XENP018087 Anti-SSTR2 (H1.143_L1.30) x Anti-CD3 (H1.30_L1.47) SSTR2 vlCDR3 SEQ ID NO: 1079
KQSYYLWT

FIGURE 14B

>XENP018087 Anti-SSTR2 (H1.143_L1.30) x Anti-CD3 (H1.30_L1.47) CD3 scFv-Fc Heavy Chain SEQ ID NO: 1080
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS/GKPGS
GKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP018087 Anti-SSTR2 (H1.143_L1.30) x Anti-CD3 (H1.30_L1.47) CD3 scFv variable heavy chain SEQ ID NO: 1081
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS >XENP018087 Anti-SSTR2 (H1.143_L1.30) x Anti-CD3 (H1.30_L1.47) CD3 scFv vhCDR1 SEQ ID NO: 1082
TYAMN >XENP018087 Anti-SSTR2 (H1.143_L1.30) x Anti-CD3 (H1.30_L1.47) CD3 scFv vhCDR2 SEQ ID NO: 1083
RIRSKYNNYATYYADSVKG >XENP018087 Anti-SSTR2 (H1.143_L1.30) x Anti-CD3 (H1.30_L1.47) CD3 scFv vhCDR3 SEQ ID NO: 1084
HGNFGDSYVSWFAY >XENP018087 Anti-SSTR2 (H1.143_L1.30) x Anti-CD3 (H1.30_L1.47) CD3 scFv variable light chain SEQ ID NO: 1085
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL >XENP018087 Anti-SSTR2 (H1.143_L1.30) x Anti-CD3 (H1.30_L1.47) CD3 scFv vlCDR1 SEQ ID NO: 1086
GSSTGAVTTSNYAN >XENP018087 Anti-SSTR2 (H1.143_L1.30) x Anti-CD3 (H1.30_L1.47) CD3 scFv vlCDR2 SEQ ID NO: 1087
GTNKRAP >XENP018087 Anti-SSTR2 (H1.143_L1.30) x Anti-CD3 (H1.30_L1.47) CD3 scFv vlCDR3 SEQ ID NO: 1088
ALWYSNHWV

FIGURE 15A

XENP18907

>XENP018907 Anti-SSTR2 (H1.143_L1.30) x Anti-CD3 (H1.32_L1.47) SSTR2 Fab-Fc Heavy Chain SEQ ID NO: 1089
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDPMDYWGQGTLVTVSS/ASTKGPSVF
PLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPV
LDSDGSFFLYSKLTVDKSRWEQGDVFSCSVMHEALHNHYTQKSLSLSPGK >XENP018907 Anti-SSTR2 (H1.143_L1.30) x Anti-CD3 (H1.32_L1.47) SSTR2 Fab variable heavy chain SEQ ID NO: 1090
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDPMDYWGQGTLVTVSS >XENP018907 Anti-SSTR2 (H1.143_L1.30) x Anti-CD3 (H1.32_L1.47) SSTR2 Fab vhCDR1 SEQ ID NO: 1091
DYGMA >XENP018907 Anti-SSTR2 (H1.143_L1.30) x Anti-CD3 (H1.32_L1.47) SSTR2 Fab vhCDR2 SEQ ID NO: 1092
FISNLGYSIYYADSVKG >XENP018907 Anti-SSTR2 (H1.143_L1.30) x Anti-CD3 (H1.32_L1.47) SSTR2 Fab vhCDR3 SEQ ID NO: 1093
APYDYDSFDPMDY >XENP018907 Anti-SSTR2 (H1.143_L1.30) x Anti-CD3 (H1.32_L1.47) SSTR2 Light Chain SEQ ID NO: 1094
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKVEIK/RTVAAPSVFIFPPSDEQLKSGTA
SVVCLLNNFYPREAKVQWKVDNALQSGNSQESVTEQDSKDSTYSLSSTLTLSKADYEKHKVYACEVTHQGLSSPVTKSFNRGEC >XENP018907 Anti-SSTR2 (H1.143_L1.30) x Anti-CD3 (H1.32_L1.47) SSTR2 variable light chain SEQ ID NO: 1095
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKVEIK >XENP018907 Anti-SSTR2 (H1.143_L1.30) x Anti-CD3 (H1.32_L1.47) SSTR2 vlCDR1 SEQ ID NO: 1096
KSSQSLLNSRNRKNYLA >XENP018907 Anti-SSTR2 (H1.143_L1.30) x Anti-CD3 (H1.32_L1.47) SSTR2 vlCDR2 SEQ ID NO: 1097
WASTRES >XENP018907 Anti-SSTR2 (H1.143_L1.30) x Anti-CD3 (H1.32_L1.47) SSTR2 vlCDR3 SEQ ID NO: 1098
KQSYYLWT

FIGURE 15B

XmAb18907

>XENP018907 Anti-SSTR2 (H1.143_L1.30) x Anti-CD3 (H1.32_L1.47) CD3 scFv-Fc Heavy Chain SEQ ID NO: 1099
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS/GKPGS
GKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/EPKSSD
KTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCSVMHEALHNHYTQKSLSLSPGK >XENP018907 Anti-SSTR2 (H1.143_L1.30) x Anti-CD3 (H1.32_L1.47) CD3 scFv variable heavy chain SEQ ID NO: 1100
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS >XENP018907 Anti-SSTR2 (H1.143_L1.30) x Anti-CD3 (H1.32_L1.47) CD3 scFv vhCDR1 SEQ ID NO: 1101
TYAMN >XENP018907 Anti-SSTR2 (H1.143_L1.30) x Anti-CD3 (H1.32_L1.47) CD3 scFv vhCDR2 SEQ ID NO: 1102
RIRSKANNYATYYADSVKG >XENP018907 Anti-SSTR2 (H1.143_L1.30) x Anti-CD3 (H1.32_L1.47) CD3 scFv vhCDR3 SEQ ID NO: 1103
HGNFGDSYVSWFAY >XENP018907 Anti-SSTR2 (H1.143_L1.30) x Anti-CD3 (H1.32_L1.47) CD3 scFv variable light chain SEQ ID NO: 1104
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL >XENP018907 Anti-SSTR2 (H1.143_L1.30) x Anti-CD3 (H1.32_L1.47) CD3 scFv vlCDR1 SEQ ID NO: 1105
GSSTGAVTTSNYAN >XENP018907 Anti-SSTR2 (H1.143_L1.30) x Anti-CD3 (H1.32_L1.47) CD3 scFv vlCDR2 SEQ ID NO: 1106
GTNKRAP >XENP018907 Anti-SSTR2 (H1.143_L1.30) x Anti-CD3 (H1.32_L1.47) CD3 scFv vlCDR3 SEQ ID NO: 1107
ALWYSNHWV

FIGURE 15C

>XENP017354 Anti-SSTR2 (H1_L1.1) x Anti-CD3 (H1.30_L1.47) Fab-Fc Heavy Chain (SEQ ID NO: 660)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017354 Anti-SSTR2 (H1_L1.1) x Anti-CD3 (H1.30_L1.47) Fab-scFv-Fc Heavy Chain (SEQ ID NO: 661)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKV
DKKVEPKSCGGGGSGGGGS/EVQLVESGGGLVQPGGSLRLSCAASGFTFSTYAMNWVRQAPGKGLEWVGRIRSKYNNYAIYYADSVKGRFTISRDDSKNTLYLQMN
SLRAEDTAVYYCVRHGNFGDSYVSWFAYWGQGTLVTVSS/GKPGSGKPGSGKPGSGKPGS/QAVVTQEPSLTVSPGGTVTLTCGSSTGAVTTSNYANWVQQKPGKS
PRGLIGGTNKRAPGVPARFSGSLLGGKAALTISGAQPEDEADYYCALWYSNHWVFGGGTKLTVL/GGGGSGGGGSKTHTCPPCPAPPVAGPSVFLFPPKPKDTLMISR
TPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQ
VKLTCLVKGFYPSDIAVEWESNGQPENNYKTTPPVLDSDGSFFLYSKLTVDKSRWQQGNVFSCSVMHEALHNHYTQKSLSLSPGK >XENP017354 Anti-SSTR2 (H1_L1.1) x Anti-CD3 (H1.30_L1.47) Light Chain (SEQ ID NO: 662)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP017355 Anti-SSTR2 (H1_L1.1) x Anti-CD3 (H1.33_L1.47) Fab-Fc Heavy Chain (SEQ ID NO: 663)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017355 Anti-SSTR2 (H1_L1.1) x Anti-CD3 (H1.33_L1.47) Fab-scFv-Fc Heavy Chain (SEQ ID NO: 664)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKV
DKKVEPKSCGGGGSGGGGS/EVQLVESGGGLVQPGGSLRLSCAASGFTFSTYAMNWVRQAPGKGLEWVGRIRSKYNNYATYYADSVKGRFTISRDDSKNTLYLQMN
SLRAEDTAVYYCVRHGNFGDSYVSWFDYWGQGTLVTVSS/GKPGSGKPGSGKPGSGKPGS/QAVVTQEPSLTVSPGGTVTLTCGSSTGAVTTSNYANWVQQKPGKS
PRGLIGGTNKRAPGVPARFSGSLLGGKAALTISGAQPEDEADYYCALWYSNHWVFGGGTKLTVL/GGGGSGGGGSKTHTCPPCPAPPVAGPSVFLFPPKPKDTLMISR
TPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQ
VKLTCLVKGFYPSDIAVEWESNGQPENNYKTTPPVLDSDGSFFLYSKLTVDKSRWQQGNVFSCSVMHEALHNHYTQKSLSLSPGK >XENP017355 Anti-SSTR2 (H1_L1.1) x Anti-CD3 (H1.33_L1.47) Light Chain (SEQ ID NO: 665)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP017356 Anti-SSTR2 (H1_L1.1) x Anti-CD3 (H1.31_L1.47) Fab-Fc Heavy Chain (SEQ ID NO: 666)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017356 Anti-SSTR2 (H1_L1.1) x Anti-CD3 (H1.31_L1.47) Fab-scFv-Fc Heavy Chain (SEQ ID NO: 667)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKV
DKKVEPKSCGGGGSGGGGS/EVQLVESGGGLVQPGGSLRLSCAASGFTFSTYAMSWVRQAPGKGLEWVGRIRSKYNNYATYADSVKGRFTISRDDSKNTLYLQMNS
LRAEDTAVYYCVRHGNFGDSYVSWFAYWGQGTLVTVSSGKPGSGKPGSGKPGSGKPGS/QAVVTQEPSLTVSPGGTVTLTCGSSTGAVTTSNYANWVQQKPGKSPR
GLIGGTNKRAPGVPARFSGSLLGGKAALTISGAQPEDEADYYCALWYSNHWVFGGGTKLTVL/GGGGSGGGGSKTHTCPPCPAPPVAGPSVFLFPPKPKDTLMISRTP
EVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVK
LTCLVKGFYPSDIAVEWESNGQPENNYKTTPPVLDSDGSFFLYSKLTVDKSRWQQGNVFSCSVMHEALHNHYTQKSLSLSPGK >XENP017356 Anti-SSTR2 (H1_L1.1) x Anti-CD3 (H1.31_L1.47) Light Chain (SEQ ID NO: 668)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15D

XENP016527 Anti-SSTR2 (H1_L1.1) x Anti-CD3 (H1.30_L1.47) Fab-Fc Heavy Chain (SEQ ID NO: 669)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP016527 Anti-SSTR2 (H1_L1.1) x Anti-CD3 (H1.30_L1.47) scFv-Fc Heavy Chain (SEQ ID NO: 670)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP016527 Anti-SSTR2 (H1_L1.1) x Anti-CD3 (H1.30_L1.47) Light Chain (SEQ ID NO: 671)
DIVMTQSPDSLAVSLGERATINCKSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP016528 Anti-SSTR2 (H1_L1.1) x Anti-CD3 (H1.33_L1.47) Fab-Fc Heavy Chain (SEQ ID NO: 672)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP016528 Anti-SSTR2 (H1_L1.1) x Anti-CD3 (H1.33_L1.47) scFv-Fc Heavy Chain (SEQ ID NO: 673)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP016528 Anti-SSTR2 (H1_L1.1) x Anti-CD3 (H1.33_L1.47) Light Chain (SEQ ID NO: 674)
DIVMTQSPDSLAVSLGERATINCKSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP016529 Anti-SSTR2 (H1_L1.1) x Anti-CD3 (H1.31_L1.47) Fab-Fc Heavy Chain (SEQ ID NO: 675)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP016529 Anti-SSTR2 (H1_L1.1) x Anti-CD3 (H1.31_L1.47) scFv-Fc Heavy Chain (SEQ ID NO: 676)
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDS
YVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSG
SLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK >XENP016529 Anti-SSTR2 (H1_L1.1) x Anti-CD3 (H1.31_L1.47) Light Chain (SEQ ID NO: 677)
DIVMTQSPDSLAVSLGERATINCKSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15E

>XENP016530 Anti-SSTR2 (H2_L1.1) x Anti-CD3 (H1.30_L1.47) Fab-Fc Heavy Chain (SEQ ID NO: 678)
QVQLVESGGGLVKPGGSLKLSCAASGFTFSDYGMAWFRQAPGKGPEWVAFISNLAYSIYYADSVKGRFTISRDNSKNTLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP016530 Anti-SSTR2 (H2_L1.1) x Anti-CD3 (H1.30_L1.47) scFv-Fc Heavy Chain (SEQ ID NO: 679)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP016530 Anti-SSTR2 (H2_L1.1) x Anti-CD3 (H1.30_L1.47) Light Chain (SEQ ID NO: 680)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP016531 Anti-SSTR2 (H2_L1.1) x Anti-CD3 (H1.33_L1.47) Fab-Fc Heavy Chain (SEQ ID NO: 681)
QVQLVESGGGLVKPGGSLKLSCAASGFTFSDYGMAWFRQAPGKGPEWVAFISNLAYSIYYADSVKGRFTISRDNSKNTLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP016531 Anti-SSTR2 (H2_L1.1) x Anti-CD3 (H1.33_L1.47) scFv-Fc Heavy Chain (SEQ ID NO: 682)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP016531 Anti-SSTR2 (H2_L1.1) x Anti-CD3 (H1.33_L1.47) Light Chain (SEQ ID NO: 683)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP016532 Anti-SSTR2 (H2_L1.1) x Anti-CD3 (H1.31_L1.47) Fab-Fc Heavy Chain (SEQ ID NO: 684)
QVQLVESGGGLVKPGGSLKLSCAASGFTFSDYGMAWFRQAPGKGPEWVAFISNLAYSIYYADSVKGRFTISRDNSKNTLYLQMNSLRAEDTAVYYCARAPYDYDSFYP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP016532 Anti-SSTR2 (H2_L1.1) x Anti-CD3 (H1.31_L1.47) scFv-Fc Heavy Chain (SEQ ID NO: 685)
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDS
YVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSG
SLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK >XENP016532 Anti-SSTR2 (H2_L1.1) x Anti-CD3 (H1.31_L1.47) Light Chain (SEQ ID NO: 686)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15F

>XENP017873 Anti-SSTR2 (H1.107_L1.1) x Anti-CD3 (H1.30_L1.47) Fab-Fc Heavy Chain (SEQ ID NO: 687)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017873 Anti-SSTR2 (H1.107_L1.1) x Anti-CD3 (H1.30_L1.47) scFv-Fc Heavy Chain (SEQ ID NO: 688)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP017873 Anti-SSTR2 (H1.107_L1.1) x Anti-CD3 (H1.30_L1.47) Light Chain (SEQ ID NO: 689)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP017874 Anti-SSTR2 (H1.107_L1.30) x Anti-CD3 (H1.30_L1.47) Fab-Fc Heavy Chain (SEQ ID NO: 690)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017874 Anti-SSTR2 (H1.107_L1.30) x Anti-CD3 (H1.30_L1.47) scFv-Fc Heavy Chain (SEQ ID NO: 691)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP017874 Anti-SSTR2 (H1.107_L1.30) x Anti-CD3 (H1.30_L1.47) Light Chain (SEQ ID NO: 692)
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP017875 Anti-SSTR2 (H1.107_L1.67) x Anti-CD3 (H1.30_L1.47) Fab-Fc Heavy Chain (SEQ ID NO: 693)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017875 Anti-SSTR2 (H1.107_L1.67) x Anti-CD3 (H1.30_L1.47) scFv-Fc Heavy Chain (SEQ ID NO: 694)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP017875 Anti-SSTR2 (H1.107_L1.67) x Anti-CD3 (H1.30_L1.47) Light Chain (SEQ ID NO: 695)
DIVMTQSPDSLAVSLGERATINCKSSQSLLNSRTRKNYLAWYQQKPDQSPKLLIYWASTRASGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15G

>XENP017876 Anti-SSTR2 (H1.107_L1.1) x Anti-CD3 (H1.33_L1.47) Fab-Fc Heavy Chain (SEQ ID NO: 696)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017876 Anti-SSTR2 (H1.107_L1.1) x Anti-CD3 (H1.33_L1.47) scFv-Fc Heavy Chain (SEQ ID NO: 697)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP017876 Anti-SSTR2 (H1.107_L1.1) x Anti-CD3 (H1.33_L1.47) Light Chain (SEQ ID NO: 698)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP017877 Anti-SSTR2 (H1.107_L1.30) x Anti-CD3 (H1.33_L1.47) Fab-Fc Heavy Chain (SEQ ID NO: 699)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017877 Anti-SSTR2 (H1.107_L1.30) x Anti-CD3 (H1.33_L1.47) scFv-Fc Heavy Chain (SEQ ID NO: 700)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP017877 Anti-SSTR2 (H1.107_L1.30) x Anti-CD3 (H1.33_L1.47) Light Chain (SEQ ID NO: 701)
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP017878 Anti-SSTR2 (H1.107_L1.67) x Anti-CD3 (H1.33_L1.47) Fab-Fc Heavy Chain (SEQ ID NO: 702)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP017878 Anti-SSTR2 (H1.107_L1.67) x Anti-CD3 (H1.33_L1.47) scFv-Fc Heavy Chain (SEQ ID NO: 703)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP017878 Anti-SSTR2 (H1.107_L1.67) x Anti-CD3 (H1.33_L1.47) Light Chain (SEQ ID NO: 704)
DIVMTQSPDSLAVSLGERATINCKSSQSLLNSRTRKNYLAWYQQKPDQSPKLLIYWASTRASGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15H

>XENP018044 Anti-SSTR2 (H1.107_L1.108) x Anti-CD3 (H1.30_L1.47) Fab-Fc Heavy Chain (SEQ ID NO: 705)
EVQLVESGGGLVQPGGSLRLSCAASGFTFS<u>DYGMA</u>WFRQAPGKGPEWVS<u>FISNLAYSIYYADSVK</u>GRFTISRDNAKNSLYLQMNSLRAEDTAVYYCAR<u>APYDYDSFDP</u>
<u>MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018044 Anti-SSTR2 (H1.107_L1.108) x Anti-CD3 (H1.30_L1.47) scFv-Fc Heavy Chain (SEQ ID NO: 706)
EVQLVESGGGLVQPGGSLRLSCAASGFTFS<u>TYAMN</u>WVRQAPGKGLEWVG<u>RIRSKYNNYATYYADSVK</u>GRFTISRDDSKNTLYLQMNSLRAEDTAVYYCVR<u>HGNFGD</u>
<u>SYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIG<u>GTNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018044 Anti-SSTR2 (H1.107_L1.108) x Anti-CD3 (H1.30_L1.47) Light Chain (SEQ ID NO: 707)
DIVMTQSPDSLAVSLGERATINC<u>KSSQSLLNSRNRKSYLA</u>WYQQKPDQSPKLLIYY<u>ASTRAS</u>GVPDRFSGSGSGTDFTLTISSLQAEDVAVYYC<u>KQSYYLWT</u>FGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018045 Anti-SSTR2 (H1.107_L1.111) x Anti-CD3 (H1.30_L1.47) Fab-Fc Heavy Chain (SEQ ID NO: 708)
EVQLVESGGGLVQPGGSLRLSCAASGFTFS<u>DYGMA</u>WFRQAPGKGPEWVS<u>FISNLAYSIYYADSVK</u>GRFTISRDNAKNSLYLQMNSLRAEDTAVYYCAR<u>APYDYDSFDP</u>
<u>MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018045 Anti-SSTR2 (H1.107_L1.111) x Anti-CD3 (H1.30_L1.47) scFv-Fc Heavy Chain (SEQ ID NO: 709)
EVQLVESGGGLVQPGGSLRLSCAASGFTFS<u>TYAMN</u>WVRQAPGKGLEWVG<u>RIRSKYNNYATYYADSVK</u>GRFTISRDDSKNTLYLQMNSLRAEDTAVYYCVR<u>HGNFGD</u>
<u>SYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIG<u>GTNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018045 Anti-SSTR2 (H1.107_L1.111) x Anti-CD3 (H1.30_L1.47) Light Chain (SEQ ID NO: 710)
DIVMTQSPDSLAVSLGERATINC<u>KSSQSLLNSRNRKSYLA</u>WYQQKPDQSPKLLIYY<u>ASTRAS</u>GVPDRFSGSGSGTDFTLTISSLQAEDVAVYYC<u>KQSYYLWT</u>FGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018046 Anti-SSTR2 (H1.107_L1.114) x Anti-CD3 (H1.30_L1.47) Fab-Fc Heavy Chain (SEQ ID NO: 711)
EVQLVESGGGLVQPGGSLRLSCAASGFTFS<u>DYGMA</u>WFRQAPGKGPEWVS<u>FISNLAYSIYYADSVK</u>GRFTISRDNAKNSLYLQMNSLRAEDTAVYYCAR<u>APYDYDSFDP</u>
<u>MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018046 Anti-SSTR2 (H1.107_L1.114) x Anti-CD3 (H1.30_L1.47) scFv-Fc Heavy Chain (SEQ ID NO: 712)
EVQLVESGGGLVQPGGSLRLSCAASGFTFS<u>TYAMN</u>WVRQAPGKGLEWVG<u>RIRSKYNNYATYYADSVK</u>GRFTISRDDSKNTLYLQMNSLRAEDTAVYYCVR<u>HGNFGD</u>
<u>SYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIG<u>GTNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018046 Anti-SSTR2 (H1.107_L1.114) x Anti-CD3 (H1.30_L1.47) Light Chain (SEQ ID NO: 713)
DIVMTQSPDSLAVSLGERATINC<u>KSSQSLLNSRNRKSYLA</u>WYQQKPDQSPKLLIYY<u>ASTRAS</u>GVPDRFSGSGSGTDFTLTISSLQAEDVAVYYC<u>KQSYYLWT</u>FGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15I

>XENP018047 Anti-SSTR2 (H1.125_L1.1) x Anti-CD3 (H1.30_L1.47) Fab-Fc Heavy Chain (SEQ ID NO: 714)
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018047 Anti-SSTR2 (H1.125_L1.1) x Anti-CD3 (H1.30_L1.47) scFv-Fc Heavy Chain (SEQ ID NO: 715)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018047 Anti-SSTR2 (H1.125_L1.1) x Anti-CD3 (H1.30_L1.47) Light Chain (SEQ ID NO: 716)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018048 Anti-SSTR2 (H1.125_L1.30) x Anti-CD3 (H1.30_L1.47) Fab-Fc Heavy Chain (SEQ ID NO: 717)
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018048 Anti-SSTR2 (H1.125_L1.30) x Anti-CD3 (H1.30_L1.47) scFv-Fc Heavy Chain (SEQ ID NO: 718)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018048 Anti-SSTR2 (H1.125_L1.30) x Anti-CD3 (H1.30_L1.47) Light Chain (SEQ ID NO: 719)
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018049 Anti-SSTR2 (H1.125_L1.108) x Anti-CD3 (H1.30_L1.47) Fab-Fc Heavy Chain (SEQ ID NO: 720)
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018049 Anti-SSTR2 (H1.125_L1.108) x Anti-CD3 (H1.30_L1.47) scFv-Fc Heavy Chain (SEQ ID NO: 721)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018049 Anti-SSTR2 (H1.125_L1.108) x Anti-CD3 (H1.30_L1.47) Light Chain (SEQ ID NO: 722)
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018053 Anti-SSTR2 (H1.107_L1.111) x Anti-CD3 (H1.33_L1.47) Fab-Fc Heavy Chain (SEQ ID NO: 732)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK

FIGURE 15J

>XENP018053 Anti-SSTR2 (H1.107_L1.111) x Anti-CD3 (H1.33_L1.47) scFv-Fc Heavy Chain (SEQ ID NO: 733)
EVQLVESGGGLVQPGGSLRLSCAASGFTFS<u>TYAMN</u>WVRQAPGKGLEWVG<u>RIRSKYNNYATYYADSVK</u>GRFTISRDDSKNTLYLQMNSLRAEDTAVYYCVR<u>HGNFGD</u>
<u>SYVSWFDY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018053 Anti-SSTR2 (H1.107_L1.111) x Anti-CD3 (H1.33_L1.47) Light Chain (SEQ ID NO: 734)
DIVMTQSPDSLAVSLGERATINC<u>KSSQSLLNSRNRKSYLA</u>WYQQKPDQSPKLLIYY<u>ASTRAS</u>GVPDRFSGSGSGTDFTLTISSLQAEDVAVYYC<u>KQSYYLWT</u>FGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018054 Anti-SSTR2 (H1.107_L1.114) x Anti-CD3 (H1.33_L1.47) Fab-Fc Heavy Chain (SEQ ID NO: 735)
EVQLVESGGGLVQPGGSLRLSCAASGFTFS<u>DYGMA</u>WFRQAPGKGPEWVS<u>FISNLAYSIYYADSVK</u>GRFTISRDNAKNSLYLQMNSLRAEDTAVYYCAR<u>APYDYDSFDP</u>
<u>MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018054 Anti-SSTR2 (H1.107_L1.114) x Anti-CD3 (H1.33_L1.47) scFv-Fc Heavy Chain (SEQ ID NO: 736)
EVQLVESGGGLVQPGGSLRLSCAASGFTFS<u>TYAMN</u>WVRQAPGKGLEWVG<u>RIRSKYNNYATYYADSVK</u>GRFTISRDDSKNTLYLQMNSLRAEDTAVYYCVR<u>HGNFGD</u>
<u>SYVSWFDY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018054 Anti-SSTR2 (H1.107_L1.114) x Anti-CD3 (H1.33_L1.47) Light Chain (SEQ ID NO: 737)
DIVMTQSPDSLAVSLGERATINC<u>KSSQSLLNSRNRKSYLA</u>WYQQKPDQSPKLLIVY<u>ASTRAS</u>GVPDRFSGSGSGTDFTLTISSLQAEDVAVYYC<u>KQSYYLWT</u>FGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018055 Anti-SSTR2 (H1.125_L1.1) x Anti-CD3 (H1.33_L1.47) Fab-Fc Heavy Chain (SEQ ID NO: 738)
EVQLVESGGGLVQPGGSLRLSCAASGFTFS<u>DYGMA</u>WFRQAPGKGPEWVS<u>FISNLGYSIYYADSVK</u>GRFTISRDNAKNSLYLQMNSLRAEDTAVYYCAR<u>APYDYDSFDP</u>
<u>MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018055 Anti-SSTR2 (H1.125_L1.1) x Anti-CD3 (H1.33_L1.47) scFv-Fc Heavy Chain (SEQ ID NO: 739)
EVQLVESGGGLVQPGGSLRLSCAASGFTFS<u>TYAMN</u>WVRQAPGKGLEWVG<u>RIRSKYNNYATYYADSVK</u>GRFTISRDDSKNTLYLQMNSLRAEDTAVYYCVR<u>HGNFGD</u>
<u>SYVSWFDY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018055 Anti-SSTR2 (H1.125_L1.1) x Anti-CD3 (H1.33_L1.47) Light Chain (SEQ ID NO: 740)
DIVMTQSPDSLAVSLGERATINC<u>KSSQSLLNSRTRKNYLA</u>WYQQKPDQSPKLLIYY<u>WASTRES</u>GVPDRFSGSGSGTDFTLTISSLQAEDVAVYYC<u>KQSYYLWT</u>FGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15K

>XENP018056 Anti-SSTR2 (H1.125_L1.30) x Anti-CD3 (H1.33_L1.47) Fab-Fc Heavy Chain (SEQ ID NO: 741)
EVQLVESGGGLVQPGGSLRLSCAASGFTFSDYGMAWFRQAPGKGPEWVSFISNLGVSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWQEGDVFSCSVMH
EALHNHYTQKSLSLSPGK >XENP018056 Anti-SSTR2 (H1.125_L1.30) x Anti-CD3 (H1.33_L1.47) scFv-Fc Heavy Chain (SEQ ID NO: 742)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018056 Anti-SSTR2 (H1.125_L1.30) x Anti-CD3 (H1.33_L1.47) Light Chain (SEQ ID NO: 743)
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018057 Anti-SSTR2 (H1.125_L1.108) x Anti-CD3 (H1.33_L1.47) Fab-Fc Heavy Chain (SEQ ID NO: 744)
EVQLVESGGGLVQPGGSLRLSCAASGFTFSDYGMAWFRQAPGKGPEWVSFISNLGVSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWQEGDVFSCSVMH
EALHNHYTQKSLSLSPGK >XENP018057 Anti-SSTR2 (H1.125_L1.108) x Anti-CD3 (H1.33_L1.47) scFv-Fc Heavy Chain (SEQ ID NO: 745)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018057 Anti-SSTR2 (H1.125_L1.108) x Anti-CD3 (H1.33_L1.47) Light Chain (SEQ ID NO: 746)
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018058 Anti-SSTR2 (H1.125_L1.111) x Anti-CD3 (H1.33_L1.47) Fab-Fc Heavy Chain (SEQ ID NO: 747)
EVQLVESGGGLVQPGGSLRLSCAASGFTFSDYGMAWFRQAPGKGPEWVSFISNLGVSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWQEGDVFSCSVMH
EALHNHYTQKSLSLSPGK >XENP018058 Anti-SSTR2 (H1.125_L1.111) x Anti-CD3 (H1.33_L1.47) scFv-Fc Heavy Chain (SEQ ID NO: 748)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018058 Anti-SSTR2 (H1.125_L1.111) x Anti-CD3 (H1.33_L1.47) Light Chain (SEQ ID NO: 749)
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15L

>XENP018059 Anti-SSTR2 (H1.125_L1.114) x Anti-CD3 (H1.33_L1.47) Fab-Fc Heavy Chain (SEQ ID NO: 750)
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018059 Anti-SSTR2 (H1.125_L1.114) x Anti-CD3 (H1.33_L1.47) scFv-Fc Heavy Chain (SEQ ID NO: 751)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018059 Anti-SSTR2 (H1.125_L1.114) x Anti-CD3 (H1.33_L1.47) Light Chain (SEQ ID NO: 752)
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018063 Anti-SSTR2 (H1.107_L1.102) x Anti-CD3 (H1.30_L1.47) Fab-Fc Heavy Chain (SEQ ID NO: 753)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018063 Anti-SSTR2 (H1.107_L1.102) x Anti-CD3 (H1.30_L1.47) scFv-Fc Heavy Chain (SEQ ID NO: 754)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018063 Anti-SSTR2 (H1.107_L1.102) x Anti-CD3 (H1.30_L1.47) Light Chain (SEQ ID NO: 755)
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018064 Anti-SSTR2 (H1.107_L1.102) x Anti-CD3 (H1.33_L1.47) Fab-Fc Heavy Chain (SEQ ID NO: 756)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018064 Anti-SSTR2 (H1.107_L1.102) x Anti-CD3 (H1.33_L1.47) scFv-Fc Heavy Chain (SEQ ID NO: 757)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018064 Anti-SSTR2 (H1.107_L1.102) x Anti-CD3 (H1.33_L1.47) Light Chain (SEQ ID NO: 758)
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15M

>XENP018065 Anti-SSTR2 (H1.125_L1.102) x Anti-CD3 (H1.30_L1.47) Fab-Fc Heavy Chain (SEQ ID NO: 759)
EVQLVESGGGLVQPGGSLRLSCAASGFTFS<u>DYGMA</u>WFRQAPGKGPEWVS<u>FISNLGYSIYYADSVK</u>GRFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018065 Anti-SSTR2 (H1.125_L1.102) x Anti-CD3 (H1.30_L1.47) scFv-Fc Heavy Chain (SEQ ID NO: 760)
EVQLVESGGGLVQPGGSLRLSCAASGFTFS<u>TYAMN</u>WVRQAPGKGLEWV<u>GRIRSKYNNYATYYADSVK</u>GRFTISRDDSKNTLYLQMNSLRAEDTAVYYCVR<u>HGNFGD
SYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWVF</u>GGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018065 Anti-SSTR2 (H1.125_L1.102) x Anti-CD3 (H1.30_L1.47) Light Chain (SEQ ID NO: 761)
DIVMTQSPDSLAVSLGERATINC<u>KSSQSLLNSRNRKSYL</u>AWYQQKPDQSPKLLIYY<u>ASTRAS</u>GVPDRFSGSGSGTDFTLTISSLQAEDVAVYYC<u>KQSYYLWT</u>FGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018066 Anti-SSTR2 (H1.125_L1.102) x Anti-CD3 (H1.33_L1.47) Fab-Fc Heavy Chain (SEQ ID NO: 762)
EVQLVESGGGLVQPGGSLRLSCAASGFTFS<u>DYGMA</u>WFRQAPGKGPEWVS<u>FISNLGYSIYYADSVK</u>GRFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018066 Anti-SSTR2 (H1.125_L1.102) x Anti-CD3 (H1.33_L1.47) scFv-Fc Heavy Chain (SEQ ID NO: 763)
EVQLVESGGGLVQPGGSLRLSCAASGFTFS<u>TYAMN</u>WVRQAPGKGLEWV<u>GRIRSKYNNYATYYADSVK</u>GRFTISRDDSKNTLYLQMNSLRAEDTAVYYCVR<u>HGNFGD
SYVSWFDY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWVF</u>GGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018066 Anti-SSTR2 (H1.125_L1.102) x Anti-CD3 (H1.33_L1.47) Light Chain (SEQ ID NO: 764)
DIVMTQSPDSLAVSLGERATINC<u>KSSQSLLNSRNRKSYL</u>AWYQQKPDQSPKLLIYY<u>ASTRAS</u>GVPDRFSGSGSGTDFTLTISSLQAEDVAVYYC<u>KQSYYLWT</u>FGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018073 Anti-SSTR2 (H1.125_L1.67) x Anti-CD3 (H1.30_L1.47) Fab-Fc Heavy Chain (SEQ ID NO: 765)
EVQLVESGGGLVQPGGSLRLSCAASGFTFS<u>DYGMA</u>WFRQAPGKGPEWVS<u>FISNLGYSIYYADSVK</u>GRFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018073 Anti-SSTR2 (H1.125_L1.67) x Anti-CD3 (H1.30_L1.47) scFv-Fc Heavy Chain (SEQ ID NO: 766)
EVQLVESGGGLVQPGGSLRLSCAASGFTFS<u>TYAMN</u>WVRQAPGKGLEWV<u>GRIRSKYNNYATYYADSVK</u>GRFTISRDDSKNTLYLQMNSLRAEDTAVYYCVR<u>HGNFGD
SYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWVF</u>GGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018073 Anti-SSTR2 (H1.125_L1.67) x Anti-CD3 (H1.30_L1.47) Light Chain (SEQ ID NO: 767)
DIVMTQSPDSLAVSLGERATINC<u>KSSQSLLNSRTRKNYLA</u>WYQQKPDQSPKLLIY<u>WASTRAS</u>GVPDRFSGSGSGTDFTLTISSLQAEDVAVYYC<u>KQSYYLWT</u>FGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15N

>XENP018074 Anti-SSTR2 (H1.125_L1.67) x Anti-CD3 (H1.33_L1.47) Fab-Fc Heavy Chain (SEQ ID NO: 768)
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMH
EALHNHYTQKSLSLSPGK >XENP018074 Anti-SSTR2 (H1.125_L1.67) x Anti-CD3 (H1.33_L1.47) scFv-Fc Heavy Chain (SEQ ID NO: 769)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018074 Anti-SSTR2 (H1.125_L1.67) x Anti-CD3 (H1.33_L1.47) Light Chain (SEQ ID NO: 770)
DIVMTQSPDSLAVSLGERATINCKSSQSLLNSRTRKNYLAWYQQKPDQSPKLLIYWASTRASGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018075 Anti-SSTR2 (H1.107_L1.110) x Anti-CD3 (H1.30_L1.47) Fab-Fc Heavy Chain (SEQ ID NO: 771)
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMH
EALHNHYTQKSLSLSPGK >XENP018075 Anti-SSTR2 (H1.107_L1.110) x Anti-CD3 (H1.30_L1.47) scFv-Fc Heavy Chain (SEQ ID NO: 772)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018075 Anti-SSTR2 (H1.107_L1.110) x Anti-CD3 (H1.30_L1.47) Light Chain (SEQ ID NO: 773)
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018076 Anti-SSTR2 (H1.125_L1.110) x Anti-CD3 (H1.30_L1.47) Fab-Fc Heavy Chain (SEQ ID NO: 774)
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMH
EALHNHYTQKSLSLSPGK >XENP018076 Anti-SSTR2 (H1.125_L1.110) x Anti-CD3 (H1.30_L1.47) scFv-Fc Heavy Chain (SEQ ID NO: 775)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018076 Anti-SSTR2 (H1.125_L1.110) x Anti-CD3 (H1.30_L1.47) Light Chain (SEQ ID NO: 776)
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 150

>XENP018087 Anti-SSTR2 (H1.143_L1.30) x Anti-CD3 (H1.30_L1.47) Fab-Fc Heavy Chain (SEQ ID NO: 777)
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018087 Anti-SSTR2 (H1.143_L1.30) x Anti-CD3 (H1.30_L1.47) scFv-Fc Heavy Chain (SEQ ID NO: 778)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018087 Anti-SSTR2 (H1.143_L1.30) x Anti-CD3 (H1.30_L1.47) Light Chain (SEQ ID NO: 779)
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018088 Anti-SSTR2 (H1.143_L1.30) x Anti-CD3 (H1.33_L1.47) Fab-Fc Heavy Chain (SEQ ID NO: 780)
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018088 Anti-SSTR2 (H1.143_L1.30) x Anti-CD3 (H1.33_L1.47) scFv-Fc Heavy Chain (SEQ ID NO: 781)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018088 Anti-SSTR2 (H1.143_L1.30) x Anti-CD3 (H1.33_L1.47) Light Chain (SEQ ID NO: 782)
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018905 Anti-SSTR2 (H1.143_L1.1) x Anti-CD3 (H1.30_L1.47) Fab-Fc Heavy Chain (SEQ ID NO: 783)
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDP
MDYWGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018905 Anti-SSTR2 (H1.143_L1.1) x Anti-CD3 (H1.30_L1.47) scFv-Fc Heavy Chain (SEQ ID NO: 784)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018905 Anti-SSTR2 (H1.143_L1.1) x Anti-CD3 (H1.30_L1.47) Light Chain (SEQ ID NO: 785)
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVE
IK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15P

>XENP018906 Anti-SSTR2 (H1.143_L1.108) x Anti-CD3 (H1.30_L1.47) Fab-Fc Heavy Chain (SEQ ID NO: 786)
EVQLVESGGGLVQPGGSLRLSCAASGFTFS<u>DYGMA</u>WFRQAPGKGLEWVS<u>FISNLGYSIYYADSVKG</u>RFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018906 Anti-SSTR2 (H1.143_L1.108) x Anti-CD3 (H1.30_L1.47) scFv-Fc Heavy Chain (SEQ ID NO: 787)
EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGD
SYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018906 Anti-SSTR2 (H1.143_L1.108) x Anti-CD3 (H1.30_L1.47) Light Chain (SEQ ID NO: 788)
DIVMTQSPDSLAVSLGERATINC<u>KSSQSLLNSRNRKSYLA</u>WYQQKPDQSPKLLIY<u>YASTRAS</u>GVPDRFSGSGSGTDFTLTISSLQAEDVAVYYC<u>KQSYYLWT</u>FGGGTKVEI
K/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018907 Anti-SSTR2 (H1.143_L1.30) x Anti-CD3 (H1.32_L1.47) Fab-Fc Heavy Chain (SEQ ID NO: 789)
EVQLVESGGGLVQPGGSLRLSCAASGFTFS<u>DYGMA</u>WFRQAPGKGLEWVS<u>FISNLGYSIYYADSVKG</u>RFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018907 Anti-SSTR2 (H1.143_L1.30) x Anti-CD3 (H1.32_L1.47) scFv-Fc Heavy Chain (SEQ ID NO: 790)
EVQLVESGGGLVQPGGSLRLSCAASGFTFS<u>TYAMN</u>WVRQAPGKGLEWVG<u>RIRSKANNYATYYADSVKG</u>RFTISRDDSKNTLYLQMNSLRAEDTAVYYCVR<u>HGNFGD
SYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018907 Anti-SSTR2 (H1.143_L1.30) x Anti-CD3 (H1.32_L1.47) Light Chain (SEQ ID NO: 791)
DIVMTQSPDSLAVSLGERATINC<u>KSSQSLLNSRNRKNYLA</u>WYQQKPDQSPKLLIY<u>WASTRES</u>GVPDRFSGSGSGTDFTLTISSLQAEDVAVYYC<u>KQSYYLWT</u>FGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP018908 Anti-SSTR2 (H1.143_L1.30) x Anti-CD3 (H1.89_L1.47) Fab-Fc Heavy Chain (SEQ ID NO: 792)
EVQLVESGGGLVQPGGSLRLSCAASGFTFS<u>DYGMA</u>WFRQAPGKGLEWVS<u>FISNLGYSIYYADSVKG</u>RFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMH
EALHNHYTQKSLSLSPGK >XENP018908 Anti-SSTR2 (H1.143_L1.30) x Anti-CD3 (H1.89_L1.47) scFv-Fc Heavy Chain (SEQ ID NO: 793)
EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGD
EYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018908 Anti-SSTR2 (H1.143_L1.30) x Anti-CD3 (H1.89_L1.47) Light Chain (SEQ ID NO: 794)
DIVMTQSPDSLAVSLGERATINC<u>KSSQSLLNSRNRKNYLA</u>WYQQKPDQSPKLLIY<u>WASTRES</u>GVPDRFSGSGSGTDFTLTISSLQAEDVAVYYC<u>KQSYYLWT</u>FGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15Q

>XENP018909 Anti-SSTR2 (H1.143_L1.30) x Anti-CD3 (H1.90_L1.47) Fab-Fc Heavy Chain (SEQ ID NO: 795)
EVQLVESGGGLVQPGGSLRLSCAASGFTFS<u>DYGMA</u>WFRQAPGKGLEWVS<u>FISNLGYSIYYADSVKG</u>RFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKV
DKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSGSFFLYSKLTVDKSRWEQGDVFSCSVMH
EALHNHYTQKSLSLSPGK >XENP018909 Anti-SSTR2 (H1.143_L1.30) x Anti-CD3 (H1.90_L1.47) scFv-Fc Heavy Chain (SEQ ID NO: 796)
EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGD
PYVSWFAY</u>WGQGTLVTVSS/GKPGSGKPGSGKPGSGKPGS/QAVVTQEPSLTVSPGGTVTLTC<u>GSSTGAVTTSNYAN</u>WVQQKPGKSPRGLIGG<u>TNKRAP</u>GVPARFS
GSLLGGKAALTISGAQPEDEADYYC<u>ALWYSNHWV</u>FGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLSPGK >XENP018909 Anti-SSTR2 (H1.143_L1.30) x Anti-CD3 (H1.90_L1.47) Light Chain (SEQ ID NO: 797)
DIVMTQSPDSLAVSLGERATINC<u>KSSQSLLNSRNRKNYLA</u>WYQQKPDQSPKLLIY<u>WASTRES</u>GVPDRFSGSGSGTDFTLTISSLQAEDVAVYYC<u>KQSYYLWT</u>FGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP019581 Anti-SSTR2 (H1.143_L1.30) x Anti-CD3 (H1.30_L1.47) Fab-Fc Heavy Chain (SEQ ID NO: 798)
EVQLVESGGGLVQPGGSLRLSCAASGFTFS<u>DYGMA</u>WFRQAPGKGLEWVS<u>FISNLGYSIYYADSVKG</u>RFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKV
DKKVEPKSCDKTHTCPPCPAPPVAGPSVFLFPPKPKDTLMISRTPEVTCVVVDVKHEDPEVQFNWYVDGVEVHNAKTKPREEQYNSTYRVVSVLTVLHQDWLNGKEY
KCKVSNKALPAPIEKTISKAKGQPREPQVYTLPPSQEEMTKNQVSLTCDVSGFYPSDIAVEWESNGQPENNYKTTPPVLDSDGSFFLYSKLTVDKSRWQEGNVFSCSVM
HEALHNHYTQKSLSLSPG >XENP019581 Anti-SSTR2 (H1.143_L1.30) x Anti-CD3 (H1.30_L1.47) scFv-Fc Heavy Chain (SEQ ID NO: 799)
EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGD
SYVSWFAY</u>WGQGTLVTVSSGGGGSGGGGSGGGGSQAVVTQEPSLTVSPGGTVTLTC<u>GSSTGAVTTSNYAN</u>WVQQKPGKSPRGLIGG<u>TNKRAP</u>GVPARFSGSLLGG
KAALTISGAQPEDEADYYC<u>ALWYSNHWV</u>FGGGTKLTVLERKSSDKTHTCPRCPAPPVAGPSVFLFPPKPKDTLMISRTPEVTCVVVDVKHEDPEVKFKWYVDGVEVH
NAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK >XENP019581 Anti-SSTR2 (H1.143_L1.30) x Anti-CD3 (H1.30_L1.47) Light Chain (SEQ ID NO: 800)
DIVMTQSPDSLAVSLGERATINC<u>KSSQSLLNSRNRKNYLA</u>WYQQKPDQSPKLLIY<u>WASTRES</u>GVPDRFSGSGSGTDFTLTISSLQAEDVAVYYC<u>KQSYYLWT</u>FGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC >XENP019582 Anti-SSTR2 (H1.143_L1.30) x Anti-CD3 (H1.32_L1.47) Fab-Fc Heavy Chain (SEQ ID NO: 801)
EVQLVESGGGLVQPGGSLRLSCAASGFTFS<u>DYGMA</u>WFRQAPGKGLEWVS<u>FISNLGYSIYYADSVKG</u>RFTISRDNAKNSLYLQMNSLRAEDTAVYYCAR<u>APYDYDSFDP
MDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKV
DKKVEPKSCDKTHTCPPCPAPPVAGPSVFLFPPKPKDTLMISRTPEVTCVVVDVKHEDPEVQFNWYVDGVEVHNAKTKPREEQYNSTYRVVSVLTVLHQDWLNGKEY
KCKVSNKALPAPIEKTISKAKGQPREPQVYTLPPSQEEMTKNQVSLTCDVSGFYPSDIAVEWESNGQPENNYKTTPPVLDSDGSFFLYSKLTVDKSRWQEGNVFSCSVM
HEALHNHYTQKSLSLSPG >XENP019582 Anti-SSTR2 (H1.143_L1.30) x Anti-CD3 (H1.32_L1.47) scFv-Fc Heavy Chain (SEQ ID NO: 802)
EVQLVESGGGLVQPGGSLRLSCAASGFTFS<u>TYAMN</u>WVRQAPGKGLEWVG<u>RIRSKANNYATYYADSVKG</u>RFTISRDDSKNTLYLQMNSLRAEDTAVYYCVR<u>HGNFGD
SYVSWFAY</u>WGQGTLVTVSSGGGGSGGGGSGGGGSQAVVTQEPSLTVSPGGTVTLTC<u>GSSTGAVTTSNYAN</u>WVQQKPGKSPRGLIGG<u>TNKRAP</u>GVPARFSGSLLGG
KAALTISGAQPEDEADYYC<u>ALWYSNHWV</u>FGGGTKLTVLERKSSDKTHTCPRCPAPPVAGPSVFLFPPKPKDTLMISRTPEVTCVVVDVKHEDPEVKFKWYVDGVEVH
NAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK >XENP019582 Anti-SSTR2 (H1.143_L1.30) x Anti-CD3 (H1.32_L1.47) Light Chain (SEQ ID NO: 803)
DIVMTQSPDSLAVSLGERATINC<u>KSSQSLLNSRNRKNYLA</u>WYQQKPDQSPKLLIY<u>WASTRES</u>GVPDRFSGSGSGTDFTLTISSLQAEDVAVYYC<u>KQSYYLWT</u>FGGGTKV
EIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 15R

>XENP13245 Anti-RSV x Anti-CD3 (H1.30_L1.47) Fab-Fc Heavy Chain (SEQ ID NO: 804)
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYF
DVWGQGTTVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDK
KVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCK
VSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEA
LHNHYTQKSLSLSPGK >XENP13245 Anti-RSV x Anti-CD3 (H1.30_L1.47) scFv-Fc Heavy Chain (SEQ ID NO: 805)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFAYWGQGTLVTVSS/GKPGSGKPGSGKPGSGKPGS/QAVVTQEPSLTVSPGTVTLCGSSTGAVTTSNYANWVQQKPGKSPRGLIGGTNKRAPGVPARFS
GSLLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQP
ENNYKTTPPVLDSDGSFFLYSKLTVDKSRWQQGNVFSCSVMHEALHNHYTQKSLSLS >XENP13245 Anti-RSV x Anti-CD3 (H1.30_L1.47) Light Chain (SEQ ID NO: 806)
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIK/RTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIGURE 16A

| | High CD3<br>Anti-CD3<br>H1.30_L1.47 | High-Int #1 CD3<br>Anti-CD3<br>H1.32_L1.47 | High-Int #2 CD3<br>Anti-CD3<br>H1.89_L1.47 | High-Int #3 CD3<br>Anti-CD3<br>H1.90_L1.47 | Int. CD3<br>Anti-CD3<br>H1.33_L1.47 | Low CD3<br>Anti-CD3<br>H1.31_L1.47 |
|---|---|---|---|---|---|---|
| Anti-SSTR2<br>H1.143_L1.30 | A, B, C, D, E, F | A, B, C, D, E, F | A, B, C, D, E, F | A, B, C, D, E, F | A, B, C, D, E, F | A, B, C, D, E, F |
| Anti-SSTR2<br>H1_L1.1 | A, B, C, D, E, F | A, B, C, D, E, F | A, B, C, D, E, F | A, B, C, D, E, F | A, B, C, D, E, F | A, B, C, D, E, F |
| Anti-SSTR2<br>H1.107_L1.130 | A, B, C, D, E, F | A, B, C, D, E, F | A, B, C, D, E, F | A, B, C, D, E, F | A, B, C, D, E, F | A, B, C, D, E, F |
| Anti-SSTR2<br>H1.107_L1.167 | A, B, C, D, E, F | A, B, C, D, E, F | A, B, C, D, E, F | A, B, C, D, E, F | A, B, C, D, E, F | A, B, C, D, E, F |
| Anti-SSTR2<br>H1.07_L1.08 | A, B, C, D, E, F | A, B, C, D, E, F | A, B, C, D, E, F | A, B, C, D, E, F | A, B, C, D, E, F | A, B, C, D, E, F |

FIGURE 16B

| | High CD3 | High-Int #1 CD3 | High-Int #2 CD3 | High-Int #3 CD3 | Int. CD3 | Low CD3 |
|---|---|---|---|---|---|---|
| | Anti-CD3 | Anti-CD3 | Anti-CD3 | Anti-CD3 | Anti-CD3 | Anti-CD3 |
| | H1.30_L1.47 | H1.32_L1.47 | H1.89_L1.47 | H1.90_L1.47 | H1.33_L1.47 | H1.31_L1.47 |
| Anti-SSTR2 H1.107_L1.111 | A, B, C, D, E, F | A, B, C, D, E, F | A, B, C, D, E, F | A, B, C, D, E, F | A, B, C, D, E, F | A, B, C, D, E, F |
| Anti-SSTR2 H1.107_L1.1 | A, B, C, D, E, F | A, B, C, D, E, F | A, B, C, D, E, F | A, B, C, D, E, F | A, B, C, D, E, F | A, B, C, D, E, F |
| Anti-SSTR2 H1.107_L1.114 | A, B, C, D, E, F | A, B, C, D, E, F | A, B, C, D, E, F | A, B, C, D, E, F | A, B, C, D, E, F | A, B, C, D, E, F |
| Anti-SSTR2 H1.107_L1.102 | A, B, C, D, E, F | A, B, C, D, E, F | A, B, C, D, E, F | A, B, C, D, E, F | A, B, C, D, E, F | A, B, C, D, E, F |
| Anti-SSTR2 H1.107_L1.110 | A, B, C, D, E, F | A, B, C, D, E, F | A, B, C, D, E, F | A, B, C, D, E, F | A, B, C, D, E, F | A, B, C, D, E, F |

FIGURE 16C

| | High CD3 | High-Int #1 CD3 | High-Int #2 CD3 | High-Int #3 CD3 | Int. CD3 | Low CD3 |
|---|---|---|---|---|---|---|
| | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-SSTR2 H1.125_L1.30 | A, B, C, D, E, F | A, B, C, D, E, F | A, B, C, D, E, F | A, B, C, D, E, F | A, B, C, D, E, F | A, B, C, D, E, F |
| Anti-SSTR2 H1.125_L1.67 | A, B, C, D, E, F | A, B, C, D, E, F | A, B, C, D, E, F | A, B, C, D, E, F | A, B, C, D, E, F | A, B, C, D, E, F |
| Anti-SSTR2 H1.125_L1.108 | A, B, C, D, E, F | A, B, C, D, E, F | A, B, C, D, E, F | A, B, C, D, E, F | A, B, C, D, E, F | A, B, C, D, E, F |
| Anti-SSTR2 H1.125_L1.111 | A, B, C, D, E, F | A, B, C, D, E, F | A, B, C, D, E, F | A, B, C, D, E, F | A, B, C, D, E, F | A, B, C, D, E, F |
| Anti-SSTR2 H1.125_L1.114 | A, B, C, D, E, F | A, B, C, D, E, F | A, B, C, D, E, F | A, B, C, D, E, F | A, B, C, D, E, F | A, B, C, D, E, F |
| Anti-SSTR2 H1.125_L1.102 | A, B, C, D, E, F | A, B, C, D, E, F | A, B, C, D, E, F | A, B, C, D, E, F | A, B, C, D, E, F | A, B, C, D, E, F |
| Anti-SSTR2 H1.125_L1.10 | A, B, C, D, E, F | A, B, C, D, E, F | A, B, C, D, E, F | A, B, C, D, E, F | A, B, C, D, E, F | A, B, C, D, E, F |

FIGURE 16D

| | High CD3<br>Anti-CD3<br>H1.30_L1.47 | High-Int #1 CD3<br>Anti-CD3<br>H1.32_L1.47 | High-Int #2 CD3<br>Anti-CD3<br>H1.89_L1.47 | High-Int #3 CD3<br>Anti-CD3<br>H1.90_L1.47 | Int. CD3<br>Anti-CD3<br>H1.33_L1.47 | Low CD3<br>Anti-CD3<br>H1.31_L1.47 |
|---|---|---|---|---|---|---|
| Anti-SSTR2<br>H1.143_L1.30 | A, B, C, D | A, B, C, D | A, B, C, D | A, B, C, D | A, B, C, D | A, B, C, D |
| Anti-SSTR2<br>H1_L1.1 | A, B, C, D | A, B, C, D | A, B, C, D | A, B, C, D | A, B, C, D | A, B, C, D |
| Anti-SSTR2<br>H1.107_L1.130 | A, B, C, D | A, B, C, D | A, B, C, D | A, B, C, D | A, B, C, D | A, B, C, D |
| Anti-SSTR2<br>H1.107_L1.167 | A, B, C, D | A, B, C, D | A, B, C, D | A, B, C, D | A, B, C, D | A, B, C, D |
| Anti-SSTR2<br>H1.07_L1.08 | A, B, C, D | A, B, C, D | A, B, C, D | A, B, C, D | A, B, C, D | A, B, C, D |

FIGURE 16E

|  | High CD3 | High-Int #1 CD3 | High-Int #2 CD3 | High-Int #3 CD3 | Int. CD3 | Low CD3 |
|---|---|---|---|---|---|---|
|  | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-SSTR2 H1.107_L1.111 | A, B, C, D | A, B, C, D | A, B, C, D | A, B, C, D | A, B, C, D | A, B, C, D |
| Anti-SSTR2 H1.107_L1.1 | A, B, C, D | A, B, C, D | A, B, C, D | A, B, C, D | A, B, C, D | A, B, C, D |
| Anti-SSTR2 H1.107_L1.114 | A, B, C, D | A, B, C, D | A, B, C, D | A, B, C, D | A, B, C, D | A, B, C, D |
| Anti-SSTR2 H1.107_L1.102 | A, B, C, D | A, B, C, D | A, B, C, D | A, B, C, D | A, B, C, D | A, B, C, D |
| Anti-SSTR2 H1.107_L1.110 | A, B, C, D | A, B, C, D | A, B, C, D | A, B, C, D | A, B, C, D | A, B, C, D |

FIGURE 16F

| | High CD3 | High-Int #1 CD3 | High-Int #2 CD3 | High-Int #3 CD3 | Int. CD3 | Low CD3 |
|---|---|---|---|---|---|---|
| | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-SSTR2 H1.125_L1.30 | A, B, C, D | A, B, C, D | A, B, C, D | A, B, C, D | A, B, C, D | A, B, C, D |
| Anti-SSTR2 H1.125_L1.67 | A, B, C, D | A, B, C, D | A, B, C, D | A, B, C, D | A, B, C, D | A, B, C, D |
| Anti-SSTR2 H1.125_L1.108 | A, B, C, D | A, B, C, D | A, B, C, D | A, B, C, D | A, B, C, D | A, B, C, D |
| Anti-SSTR2 H1.125_L1.111 | A, B, C, D | A, B, C, D | A, B, C, D | A, B, C, D | A, B, C, D | A, B, C, D |
| Anti-SSTR2 H1.125_L1.114 | A, B, C, D | A, B, C, D | A, B, C, D | A, B, C, D | A, B, C, D | A, B, C, D |
| Anti-SSTR2 H1.125_L1.102 | A, B, C, D | A, B, C, D | A, B, C, D | A, B, C, D | A, B, C, D | A, B, C, D |
| Anti-SSTR2 H1.125_L1.10 | A, B, C, D | A, B, C, D | A, B, C, D | A, B, C, D | A, B, C, D | A, B, C, D |

Figure 17B
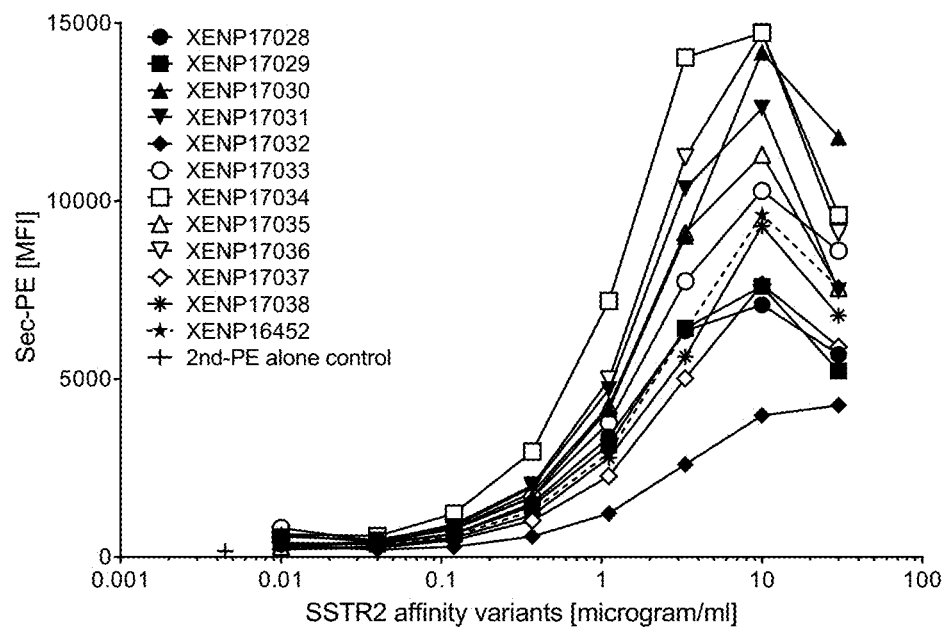
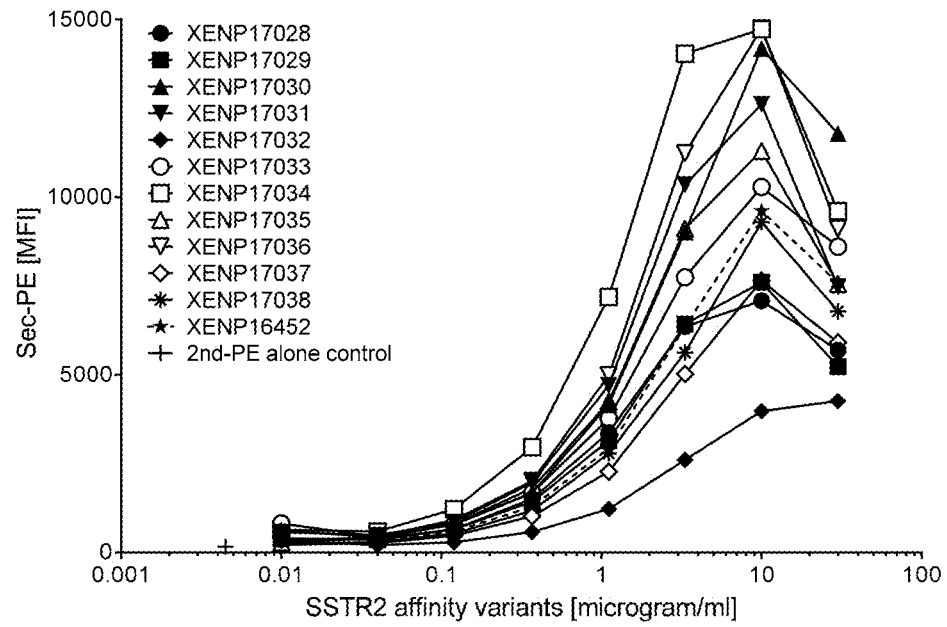

Figure 17C
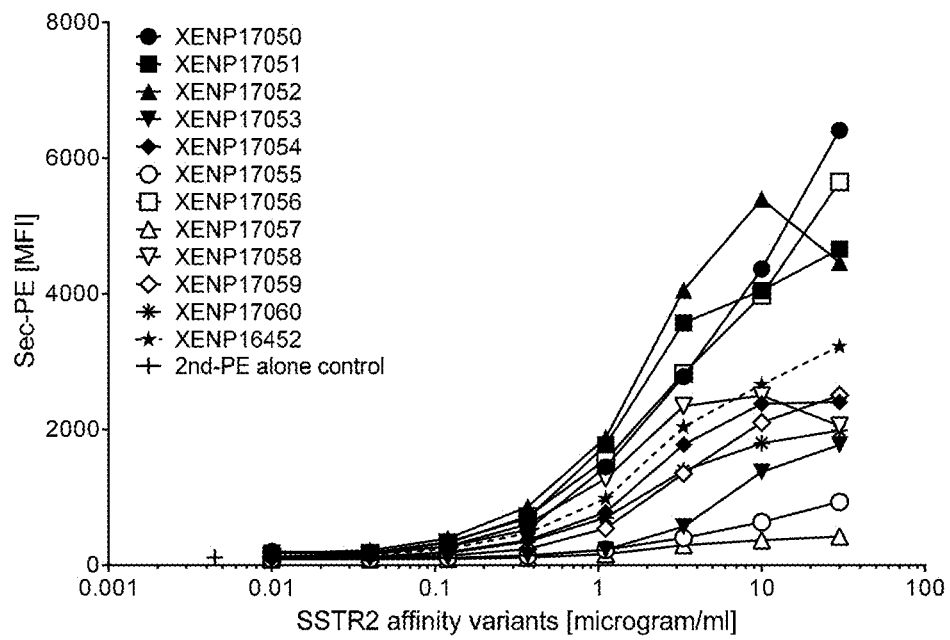
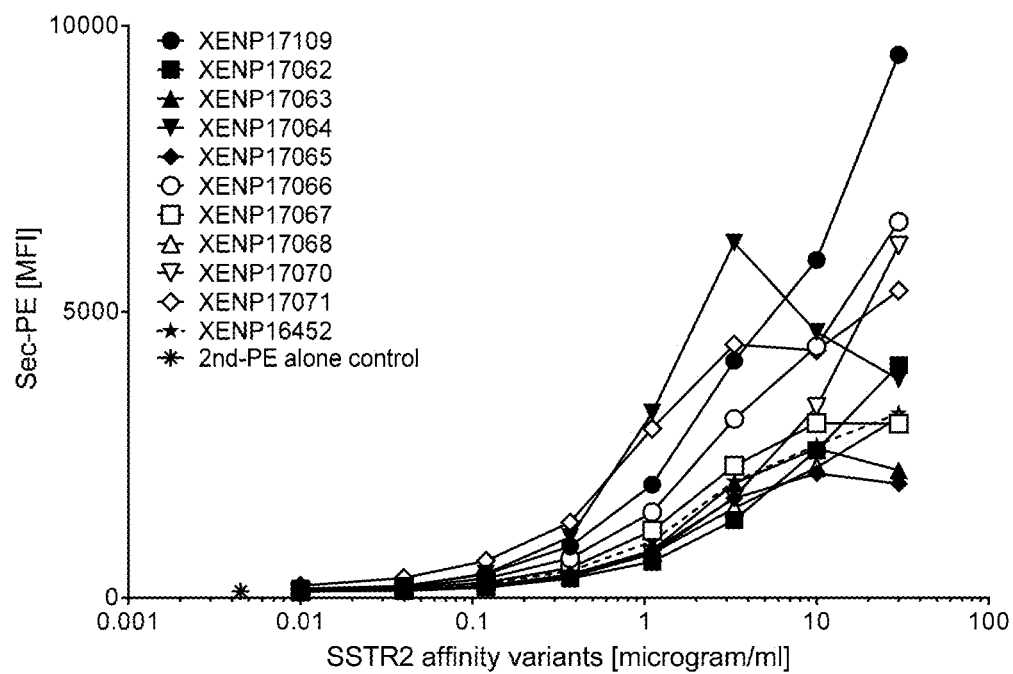

Figure 17D
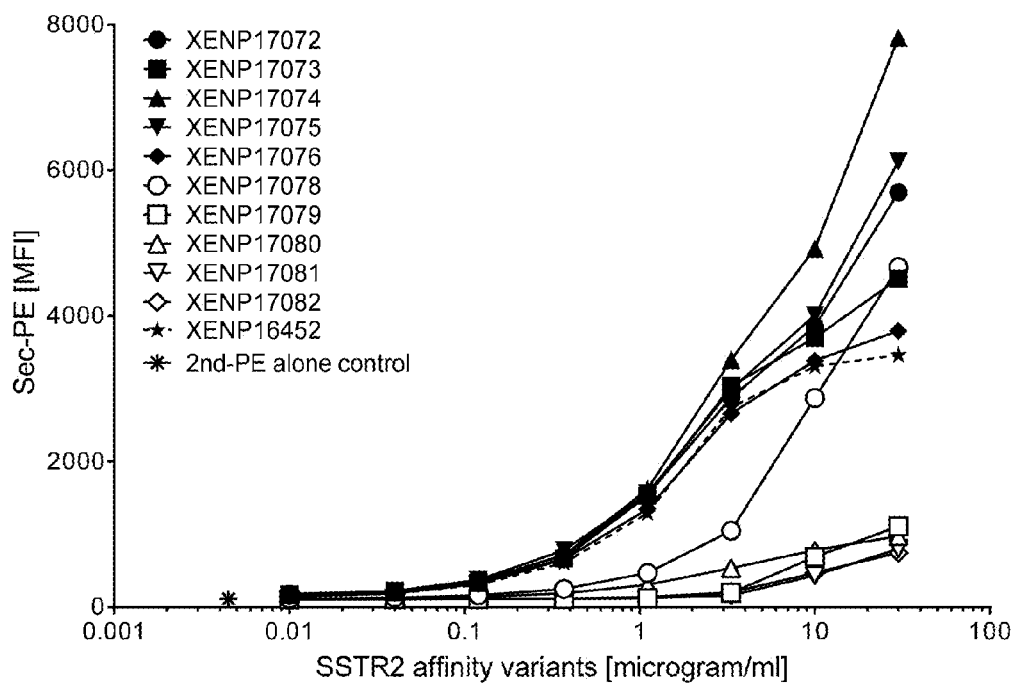
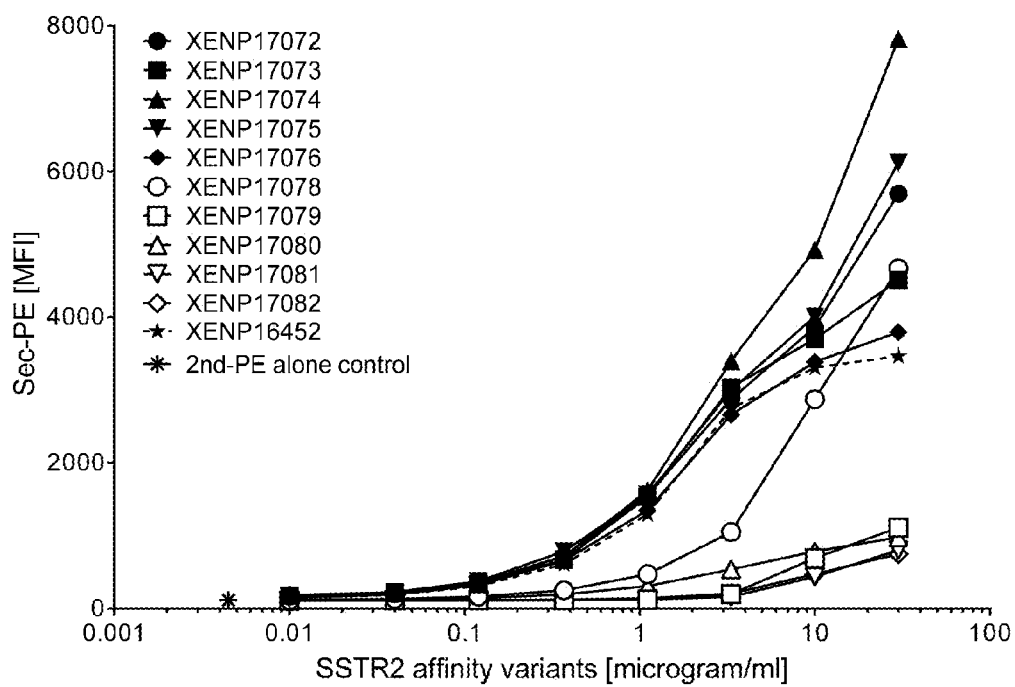

Figure 17E
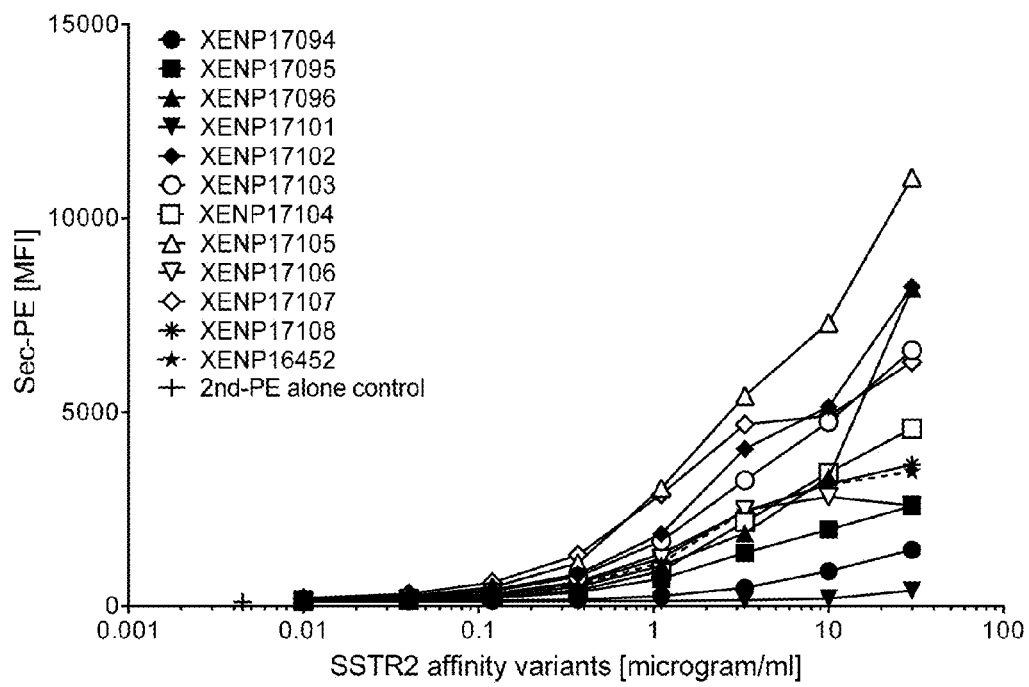
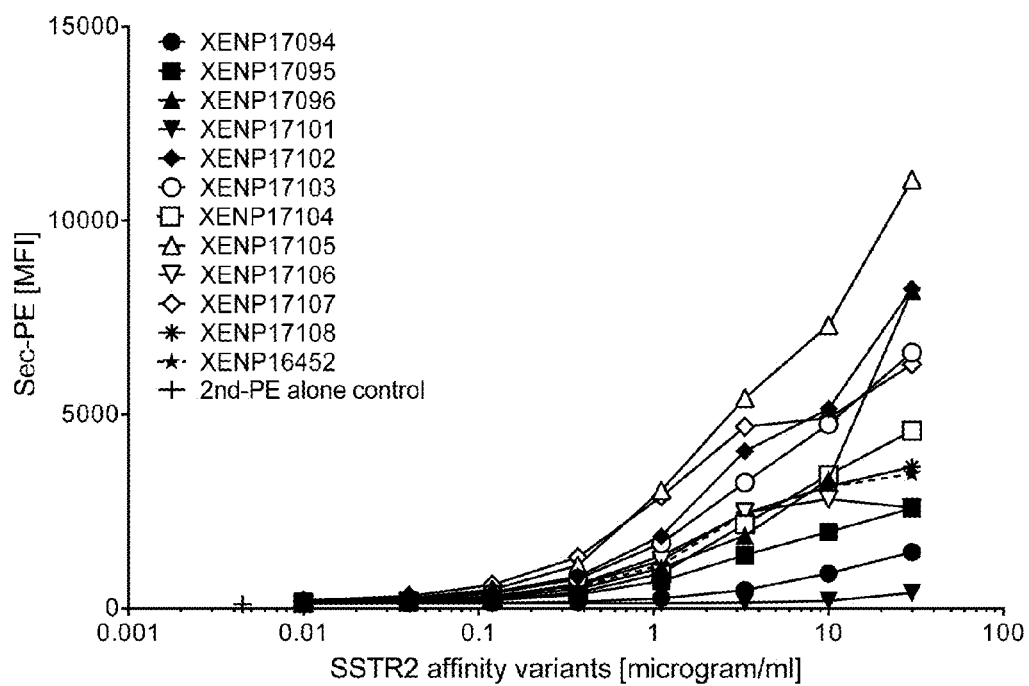

Figure 17G
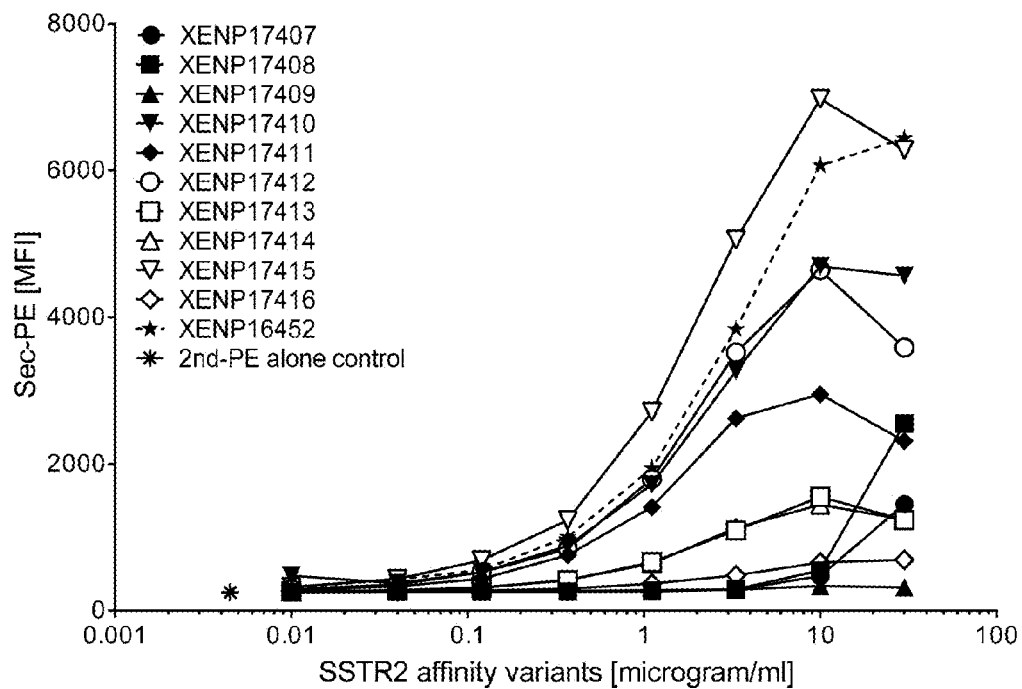
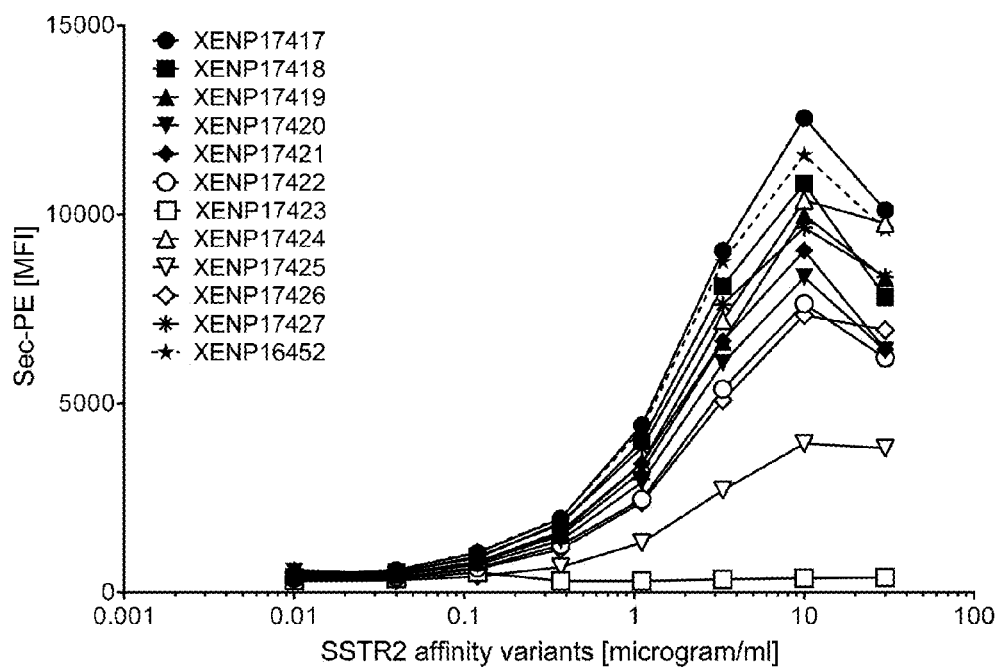

Figure 17H
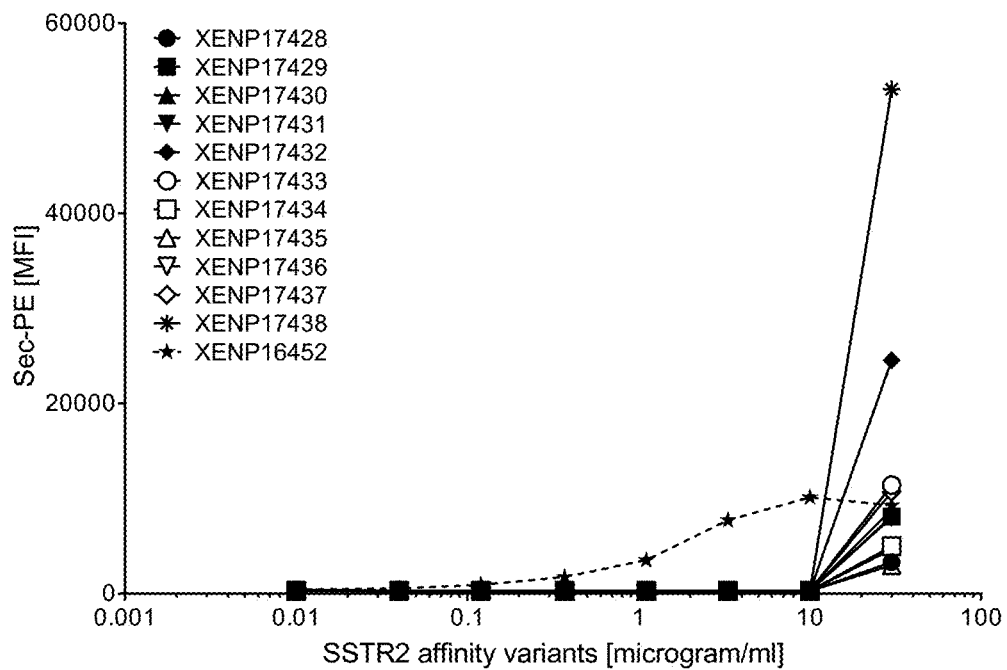
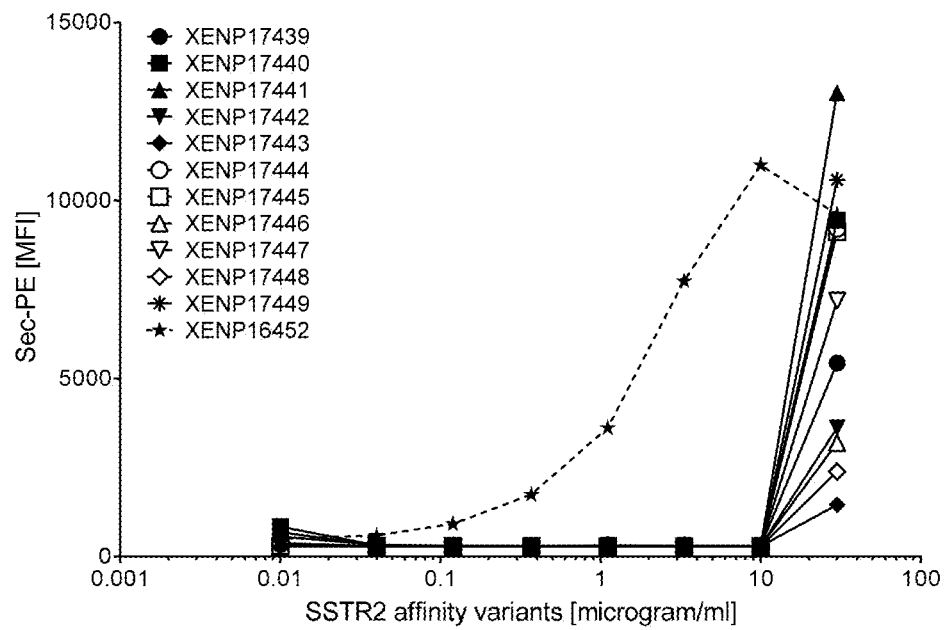

Figure 17I
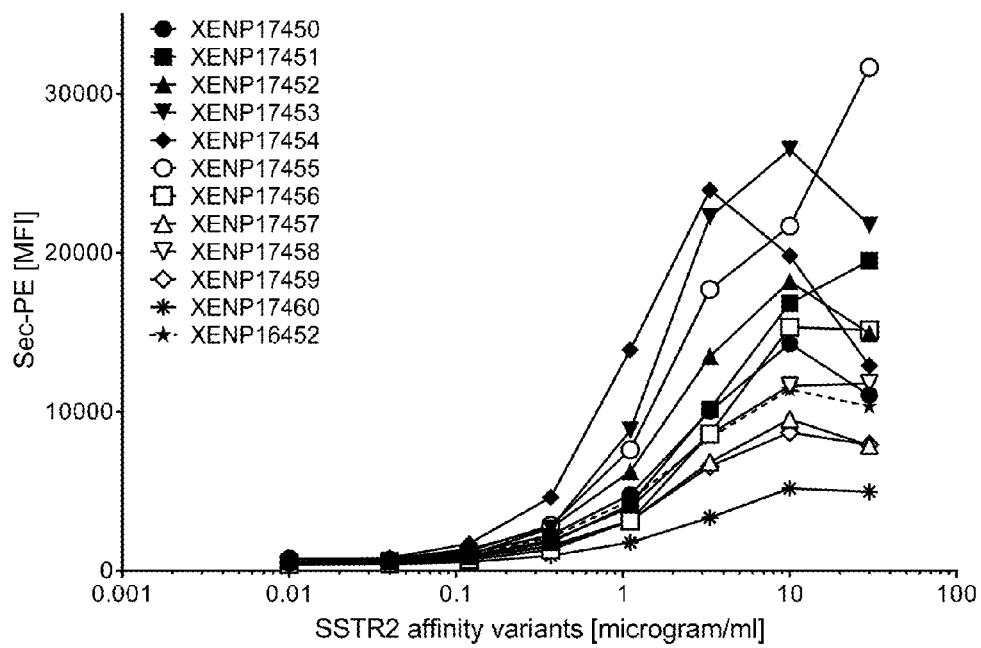
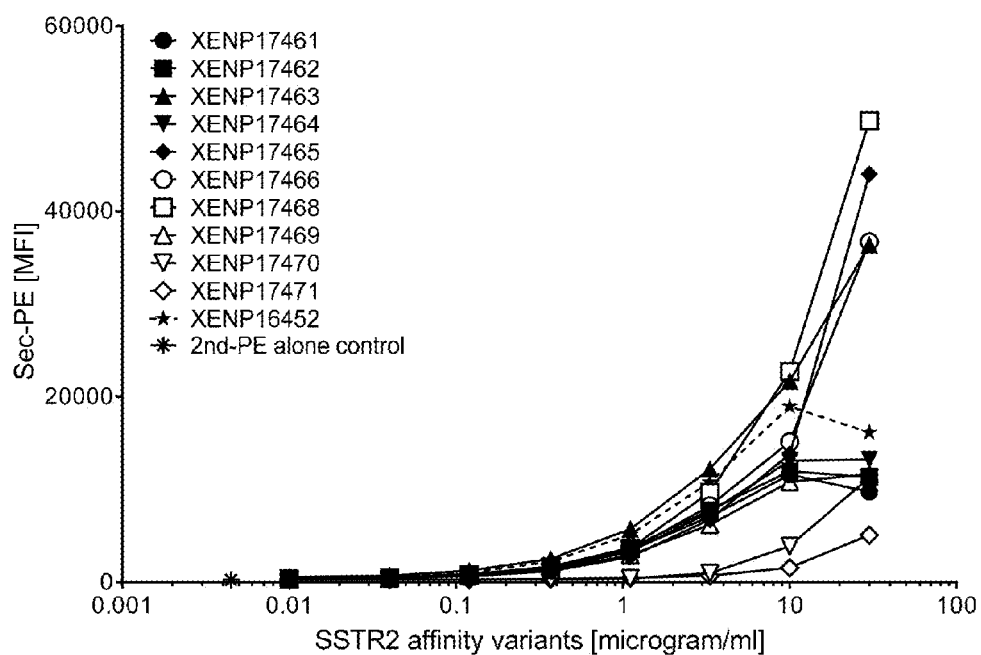

Figure 17J
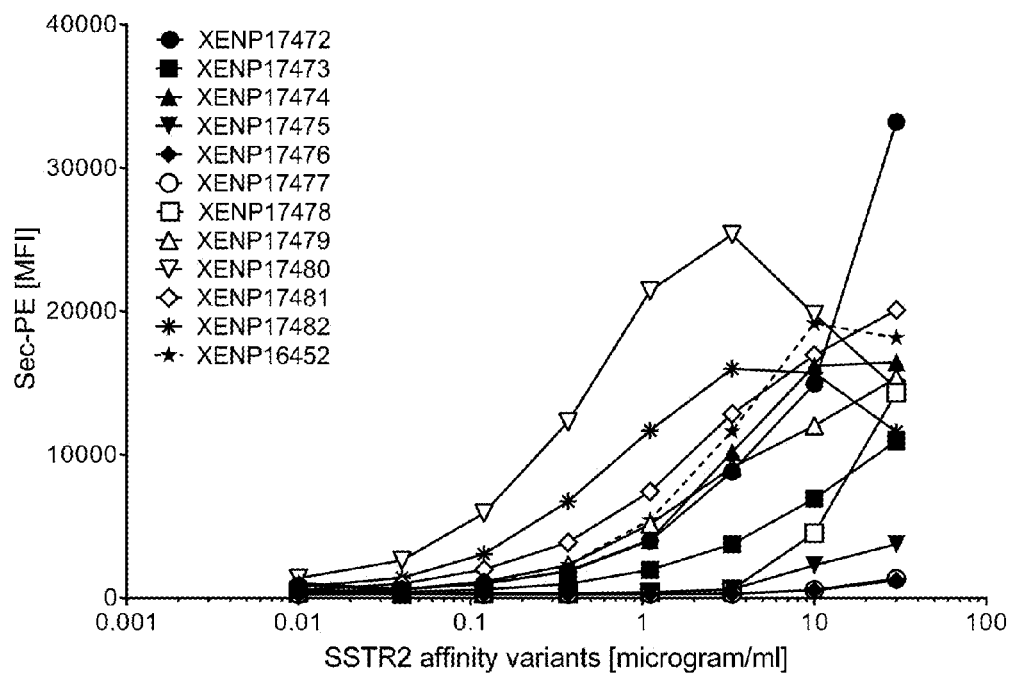
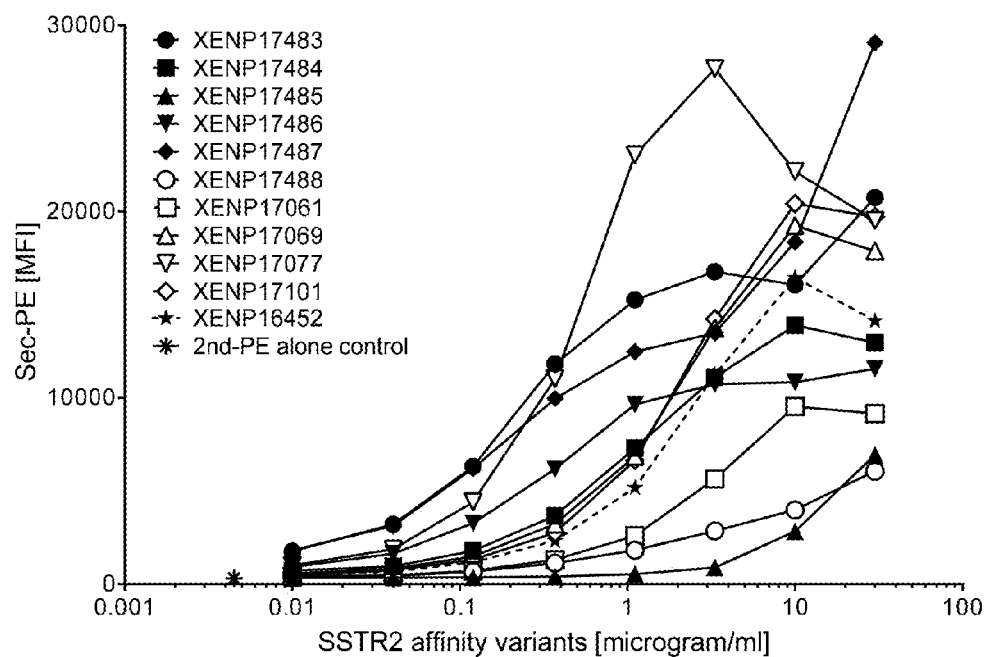

Figure 17K
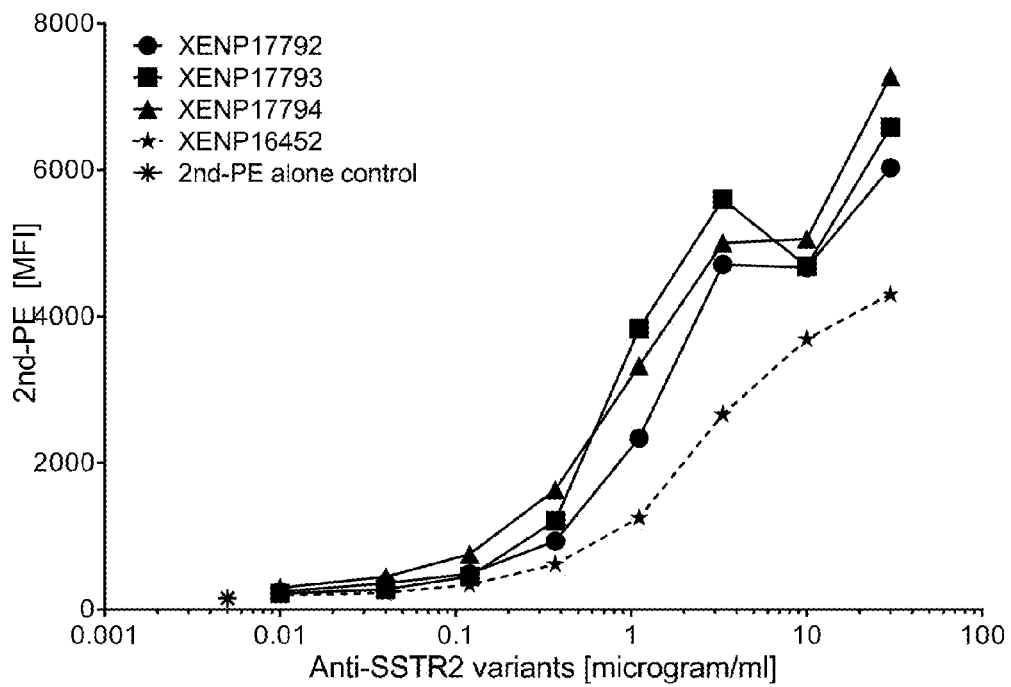
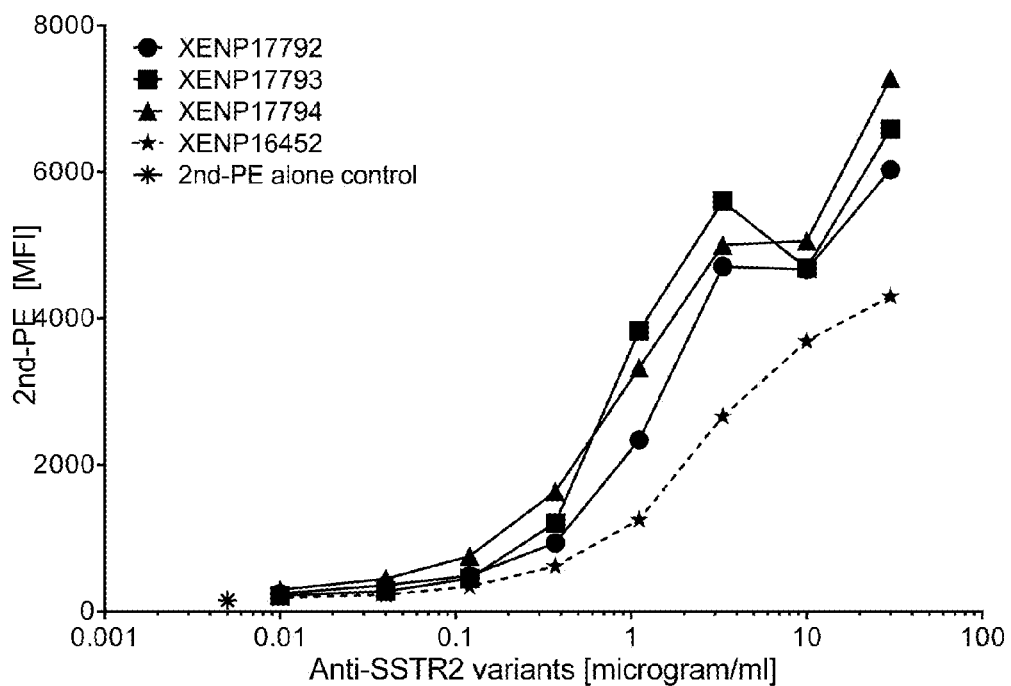

Figure 17L
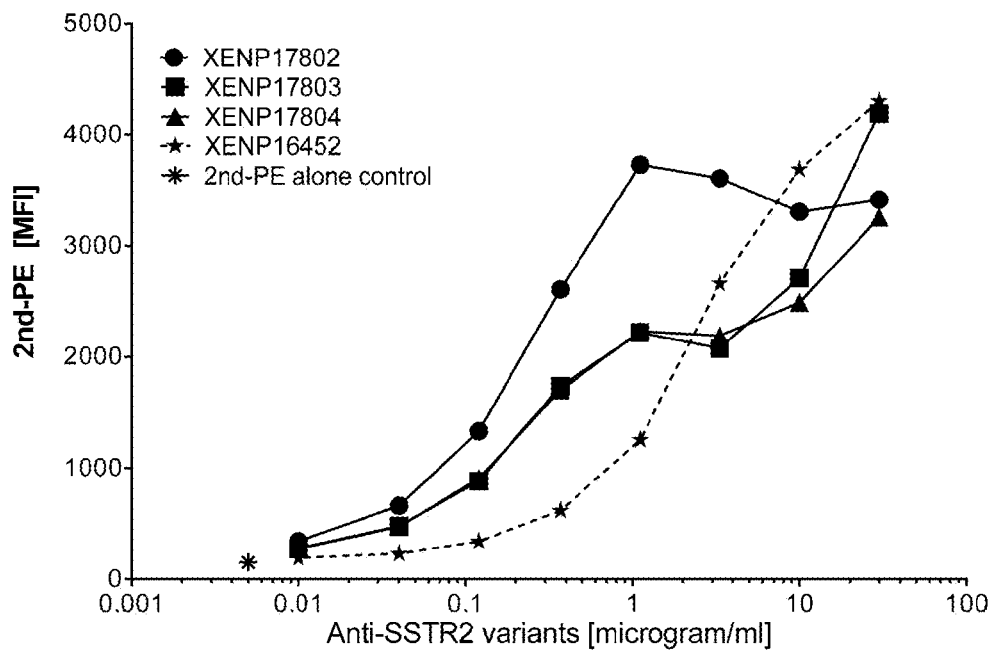
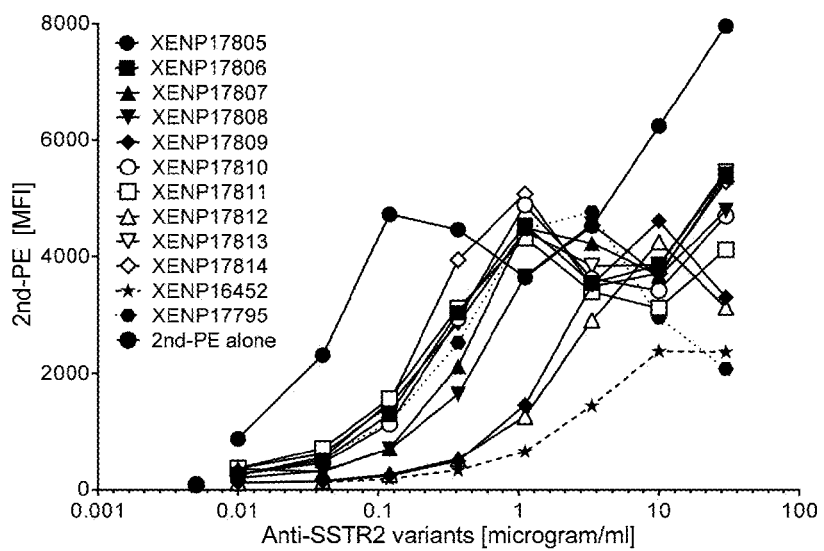

Figure 17M
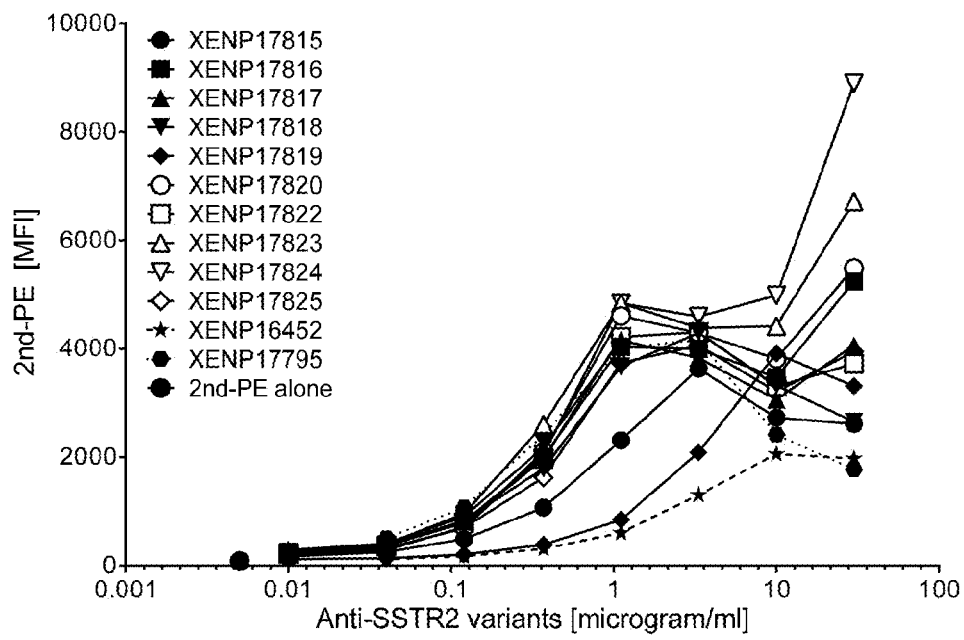
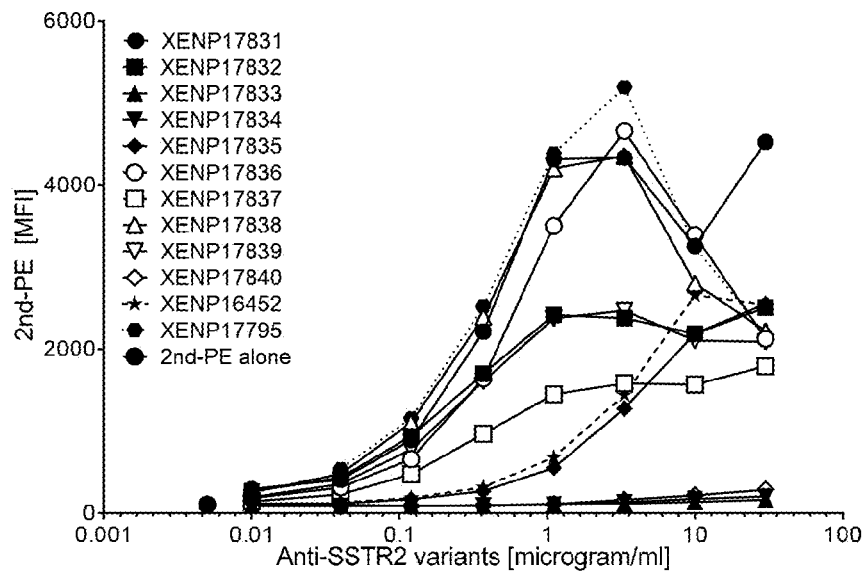

Figure 17N
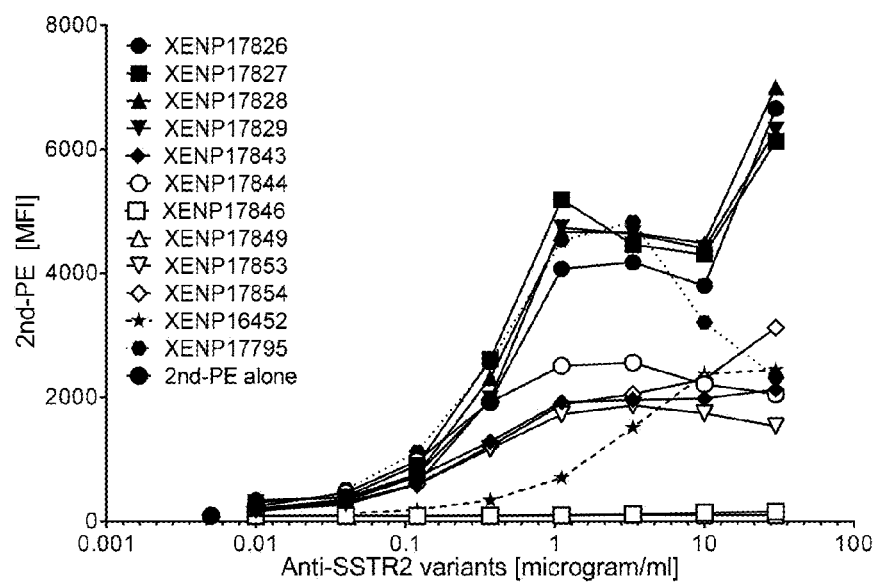
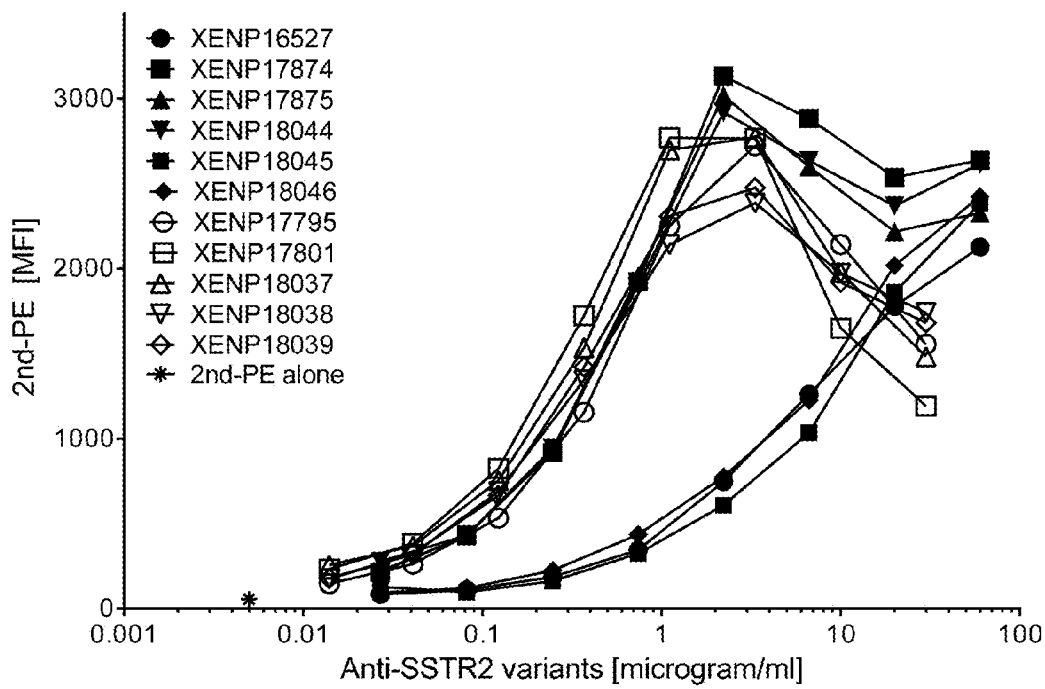

Figure 17O
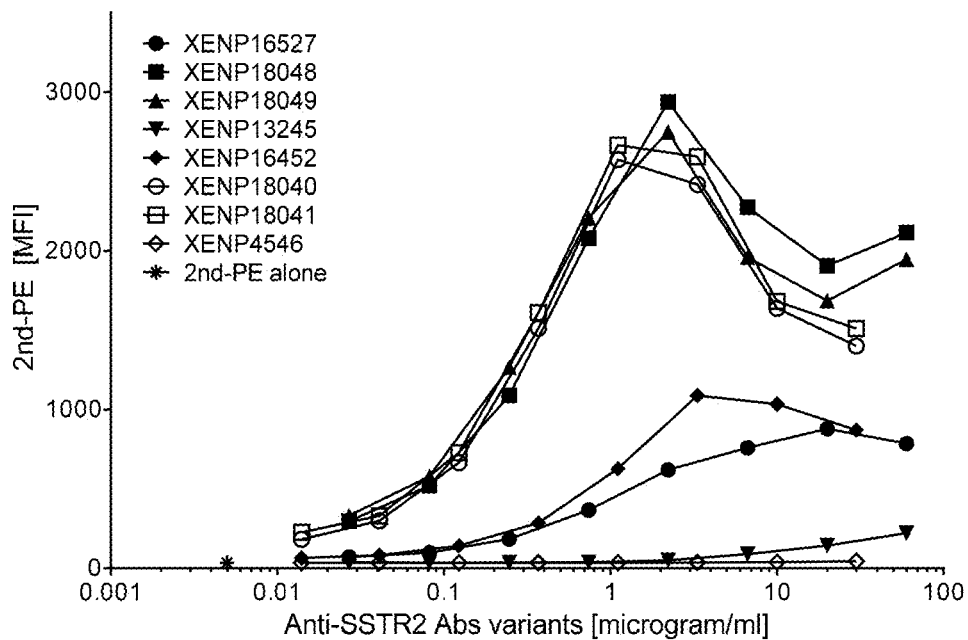
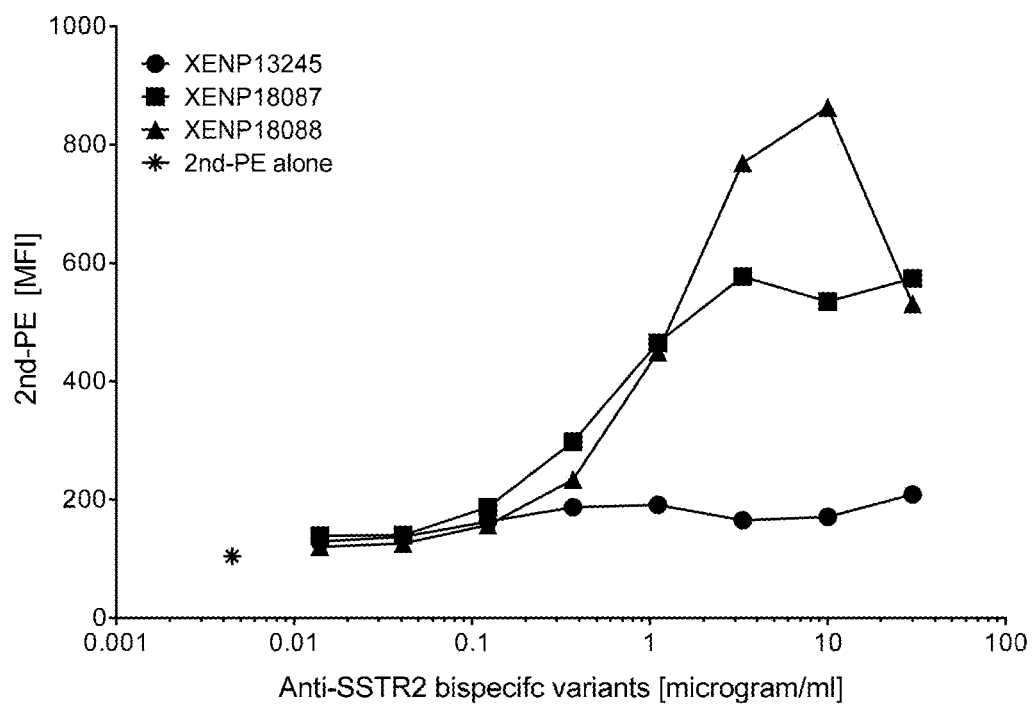

Figure 17P
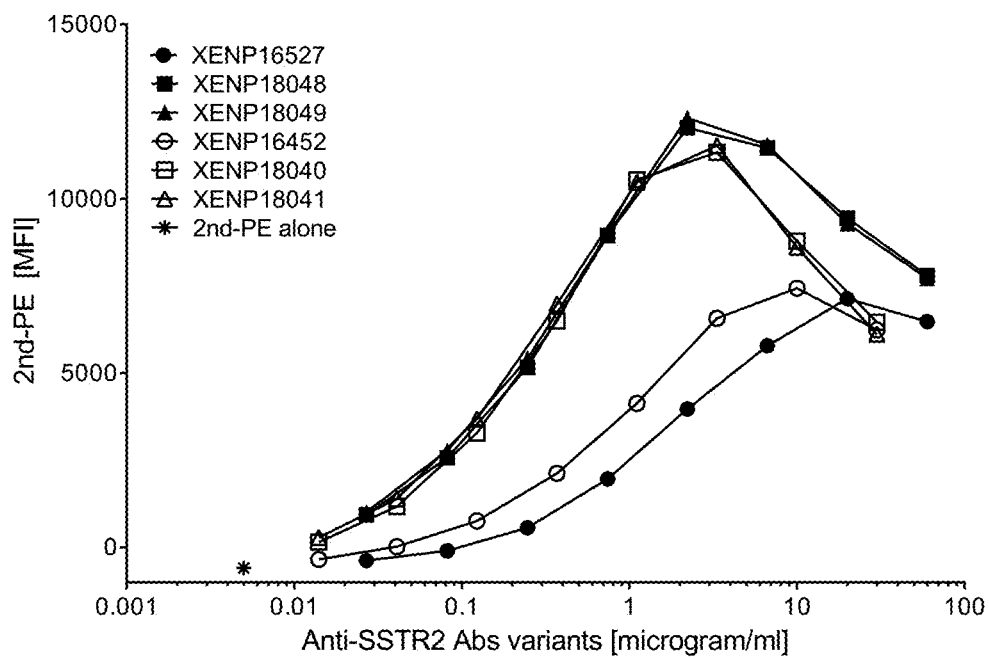
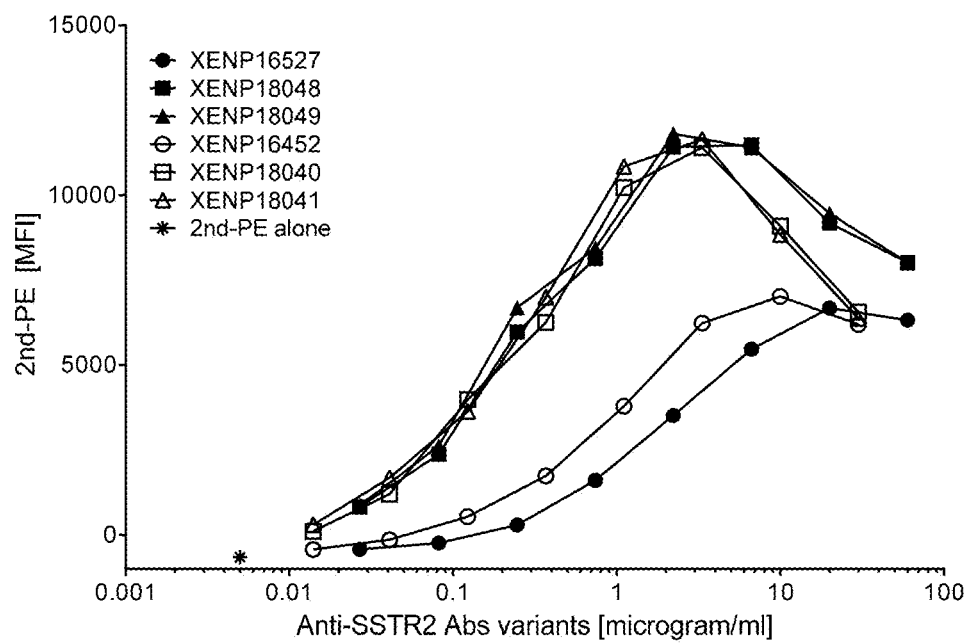

Figure 18A
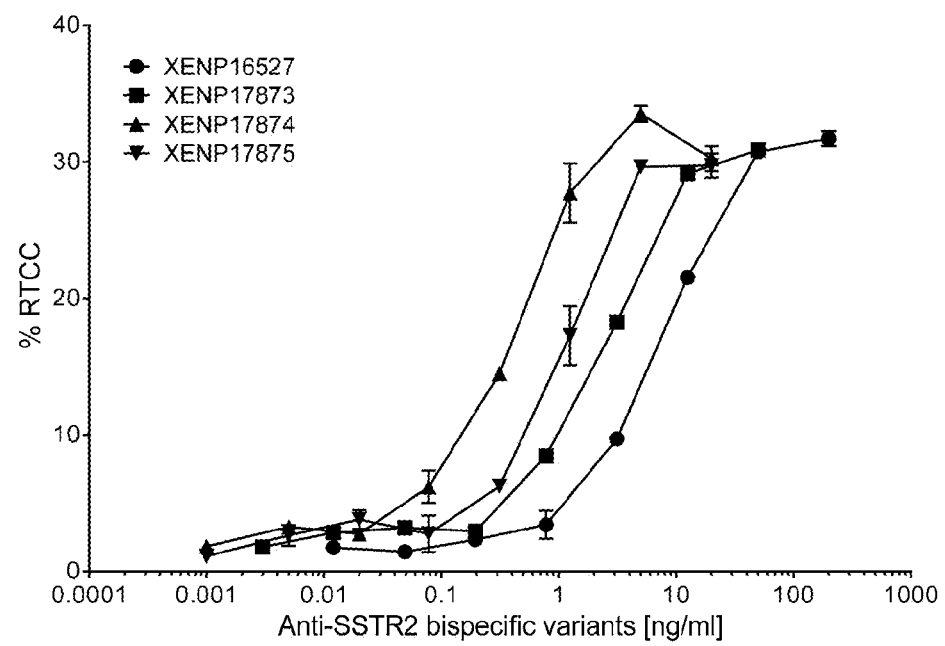
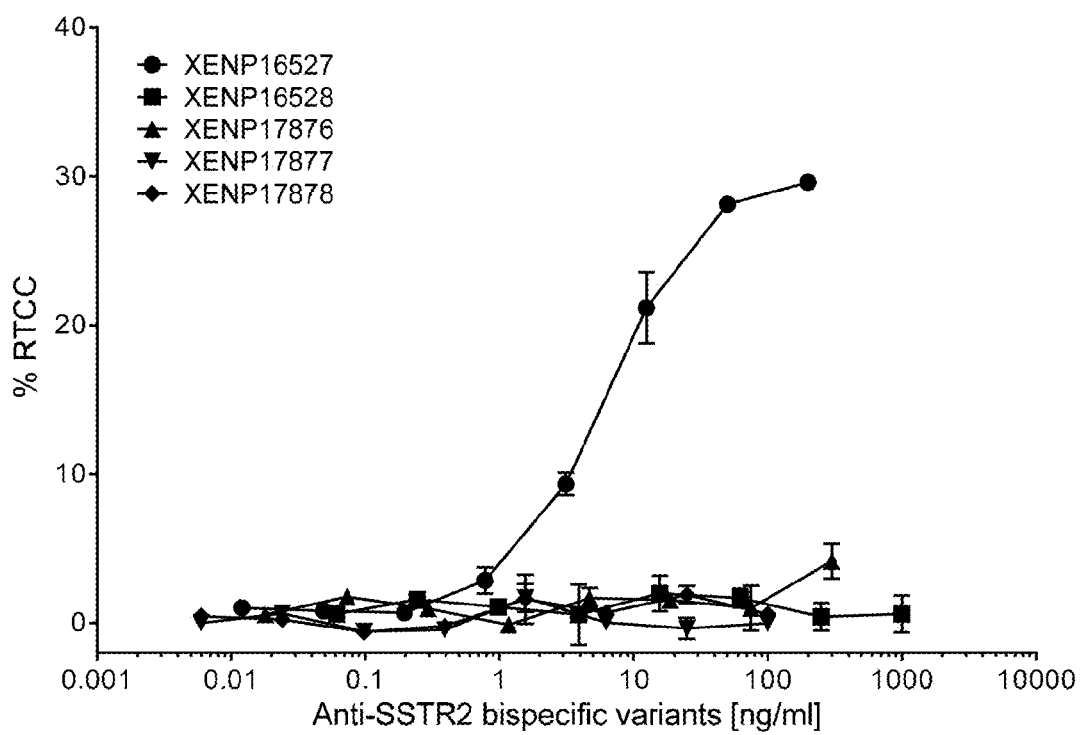

Figure 18B
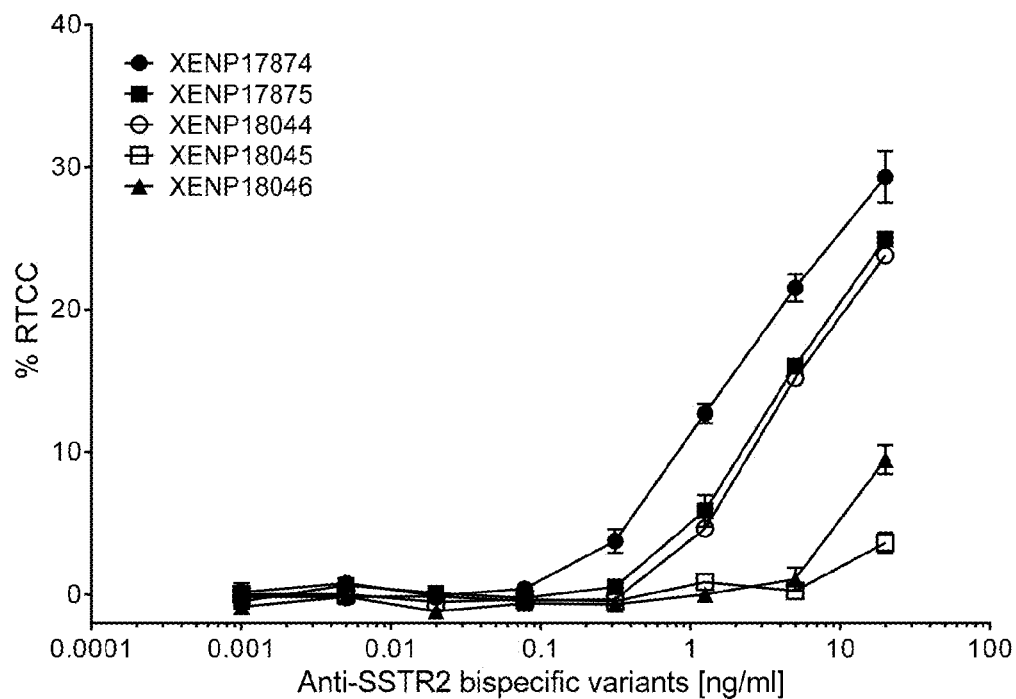
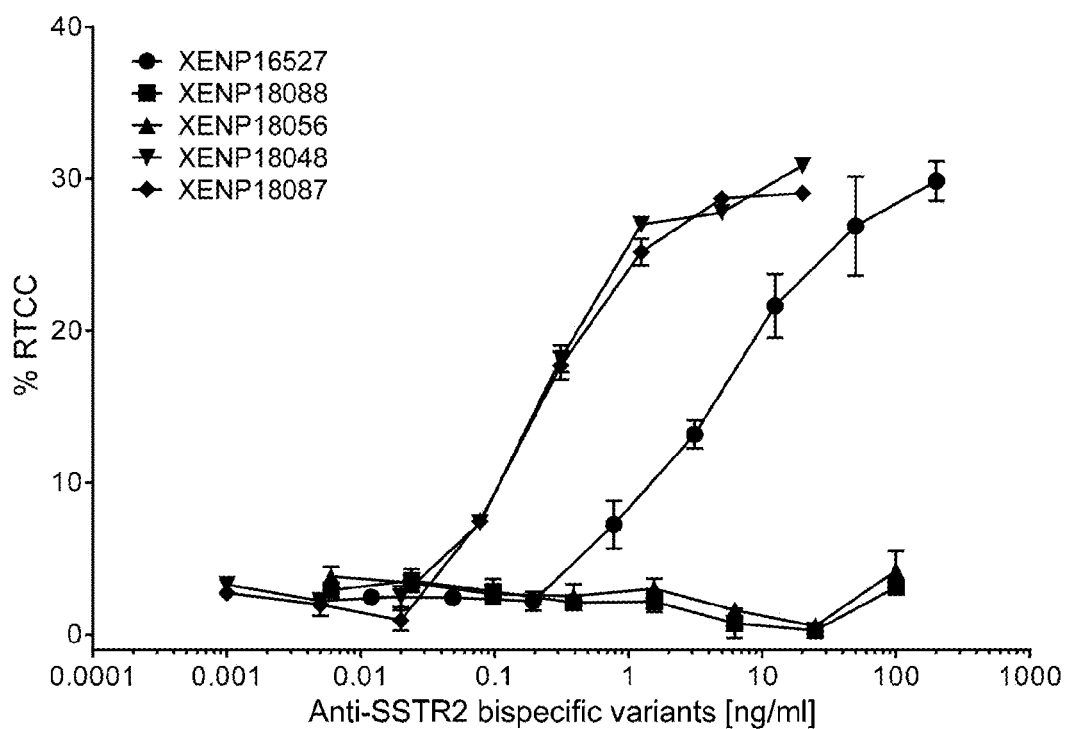

Figure 18C
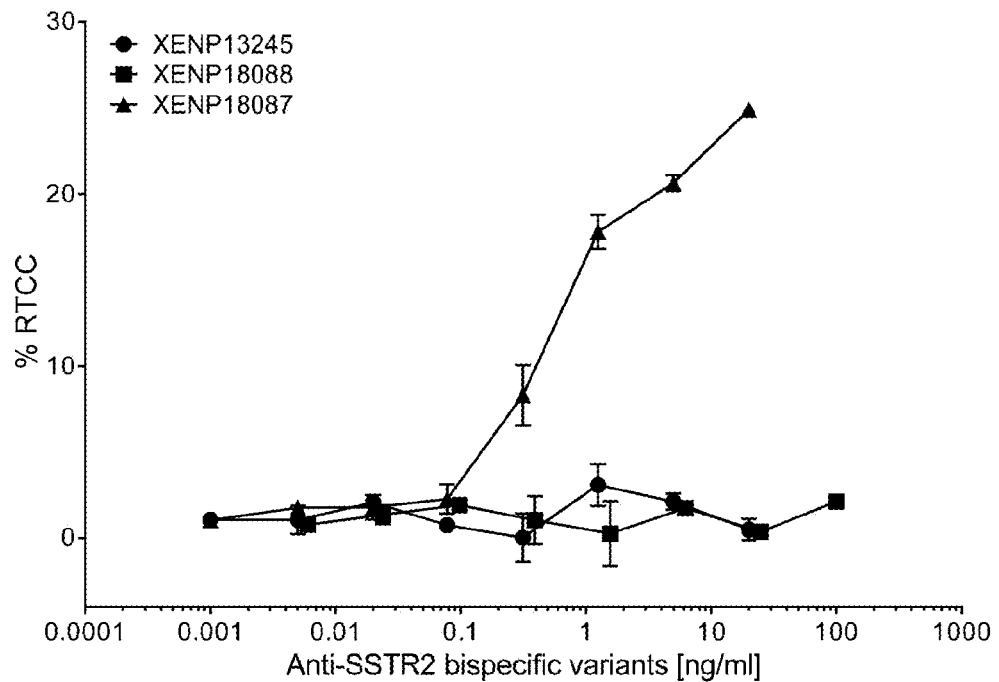
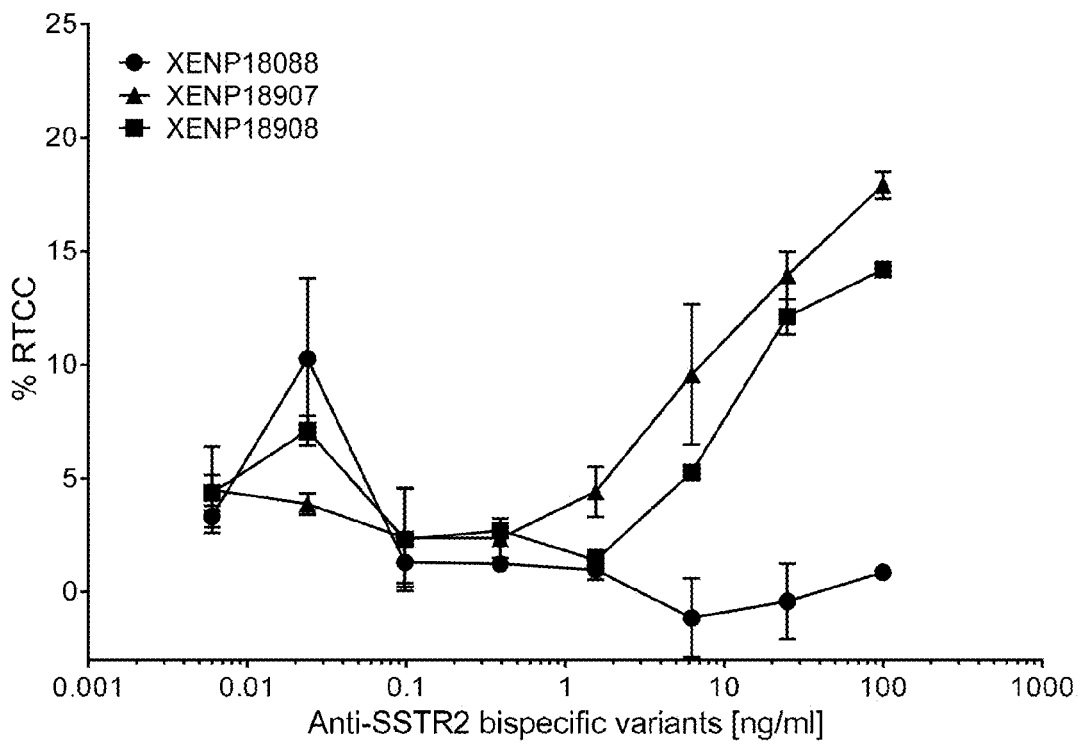

Figure 18D
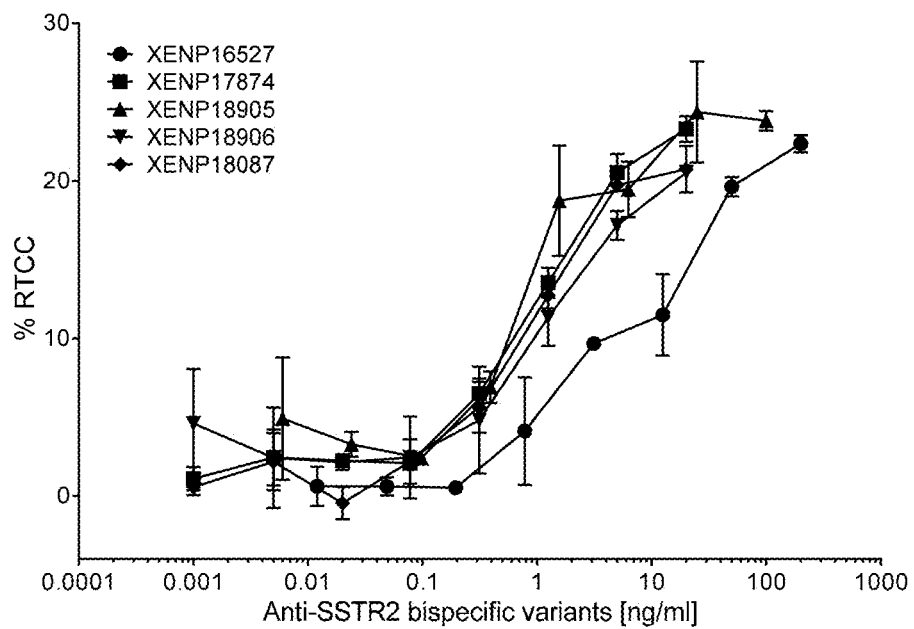
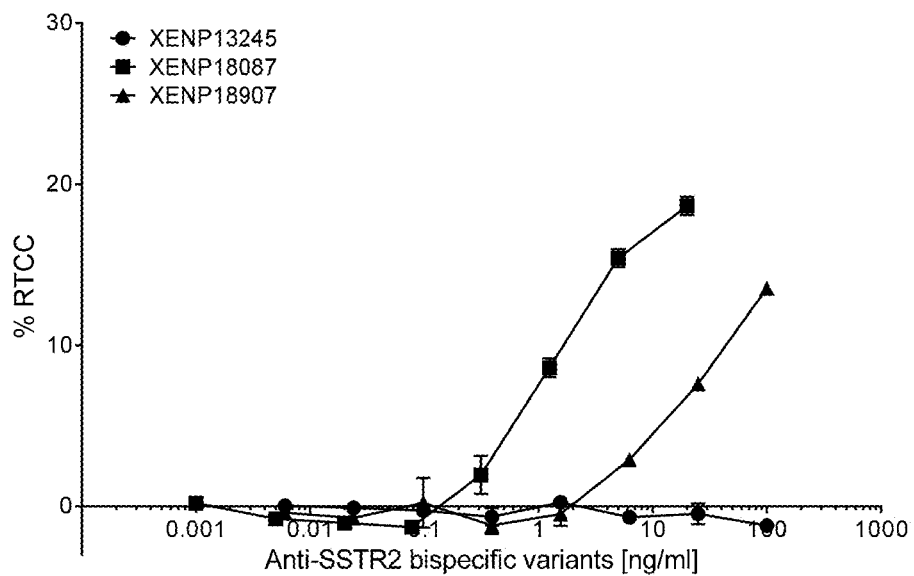

Figure 19A
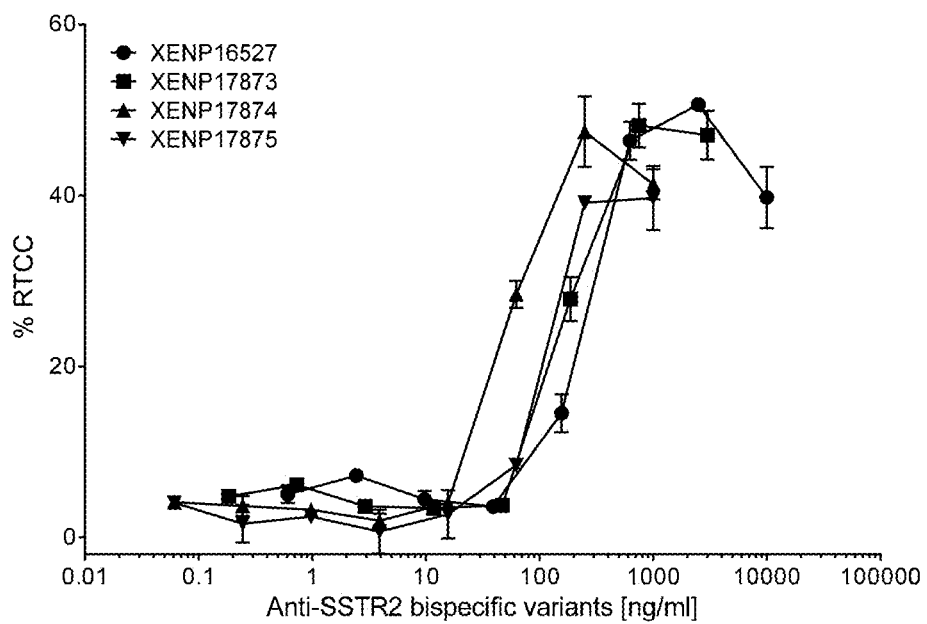
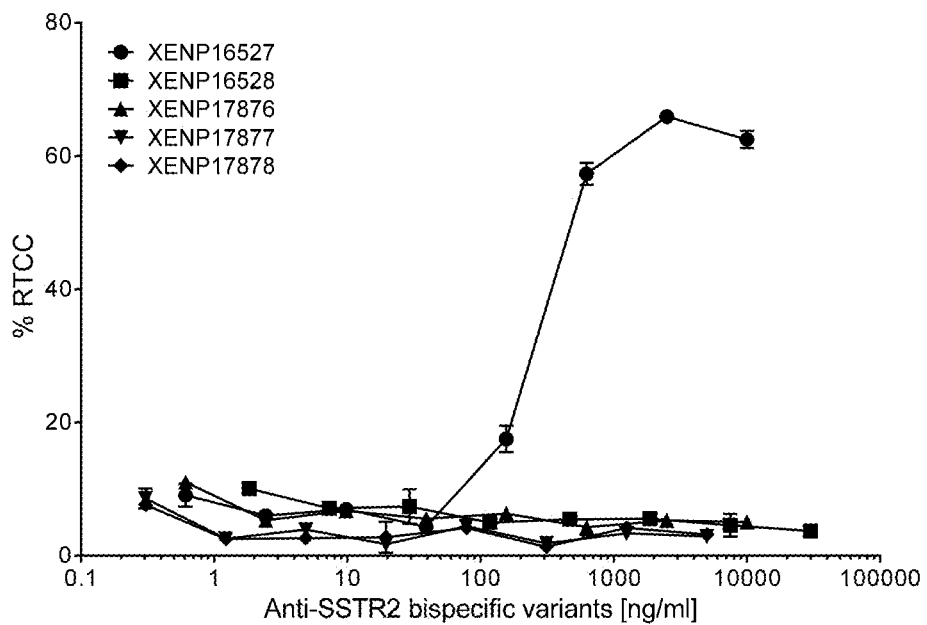

Figure 19B
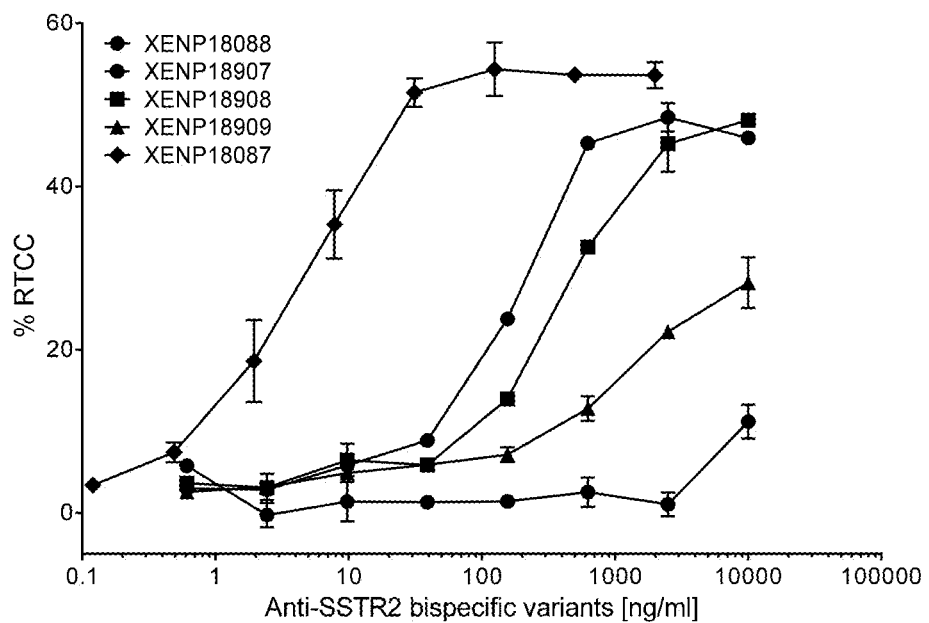
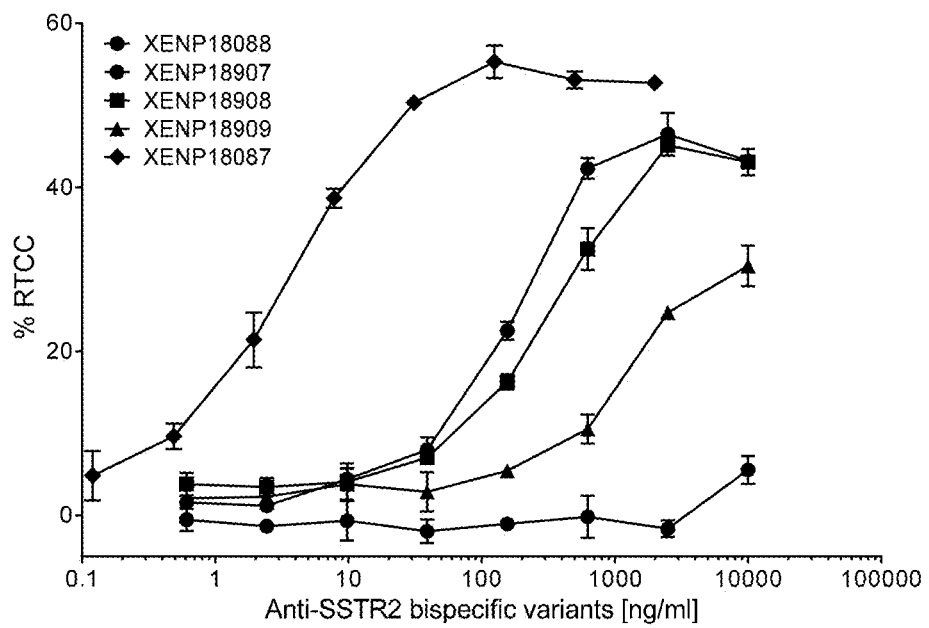

Figure 20A
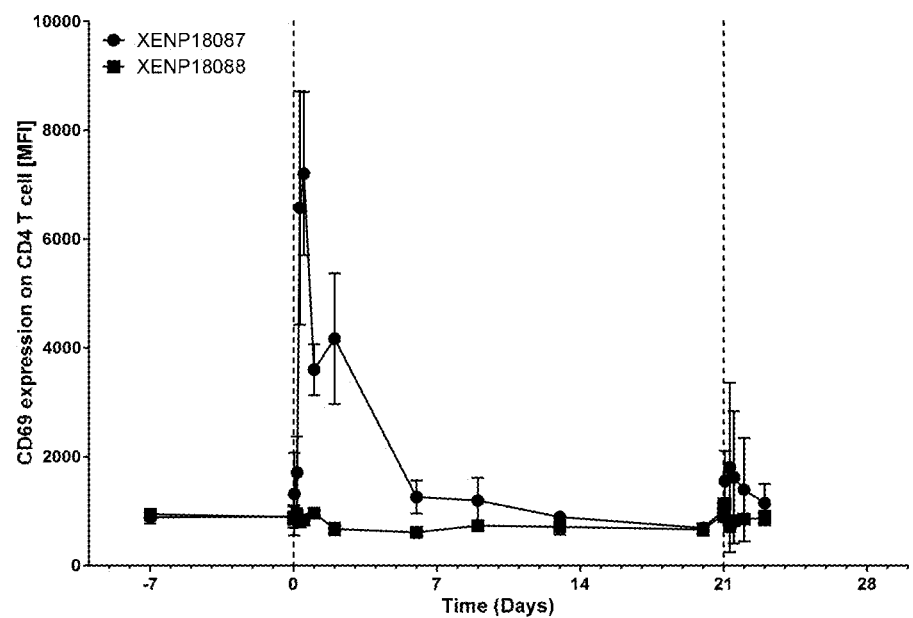
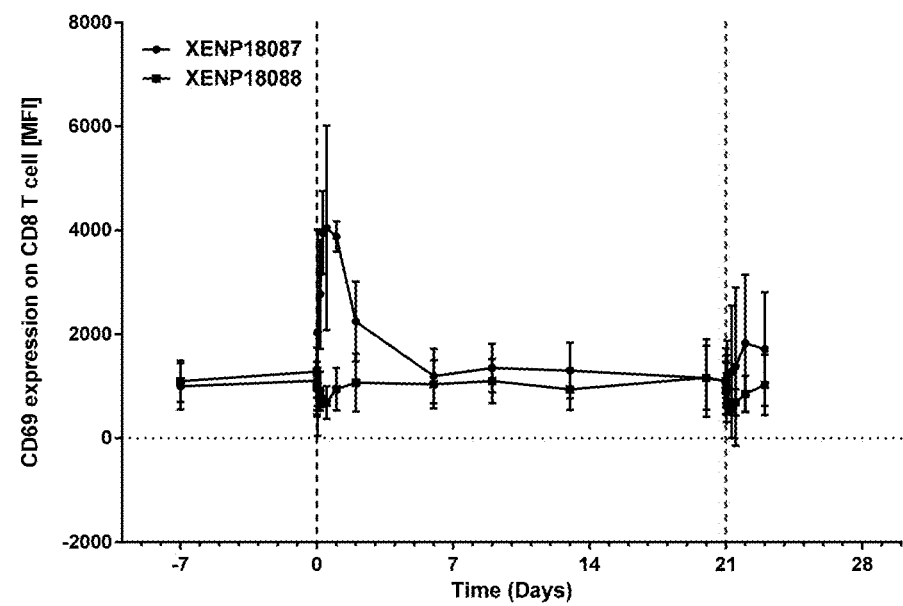

Figure 21A
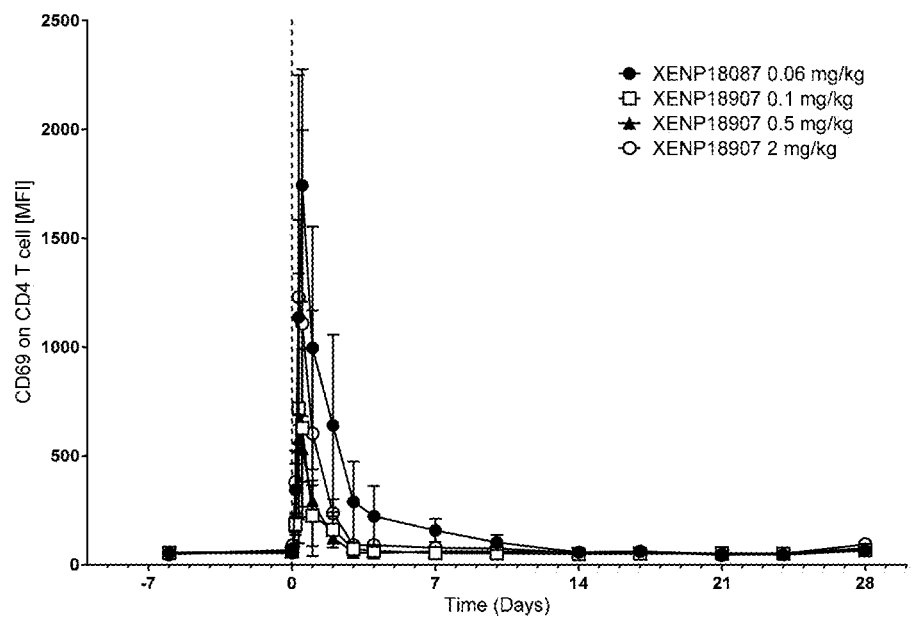
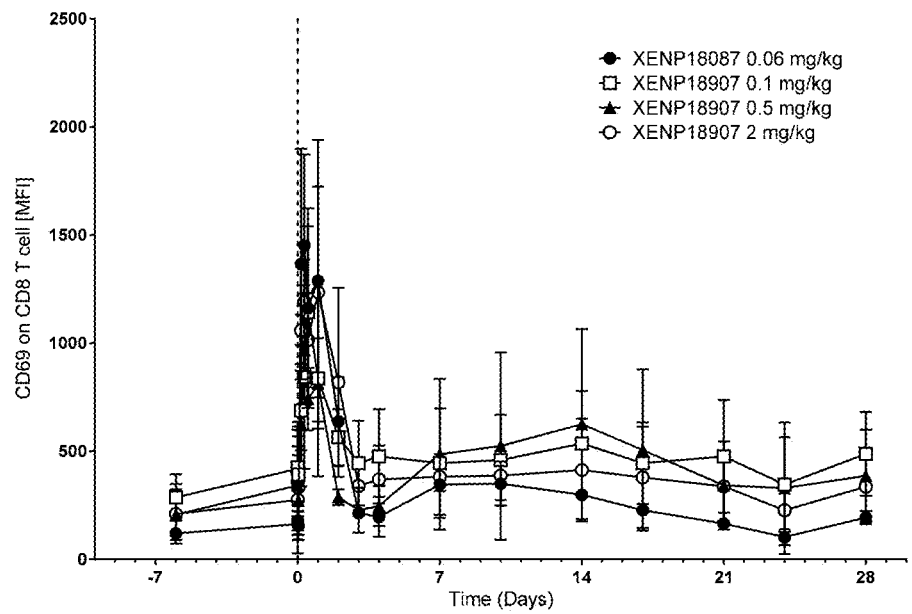

Figure 21B
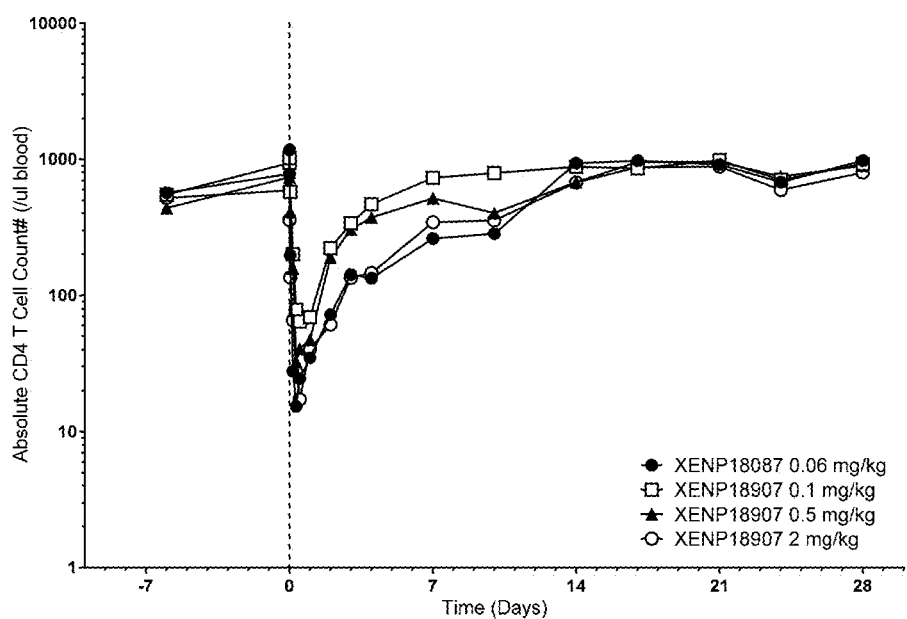
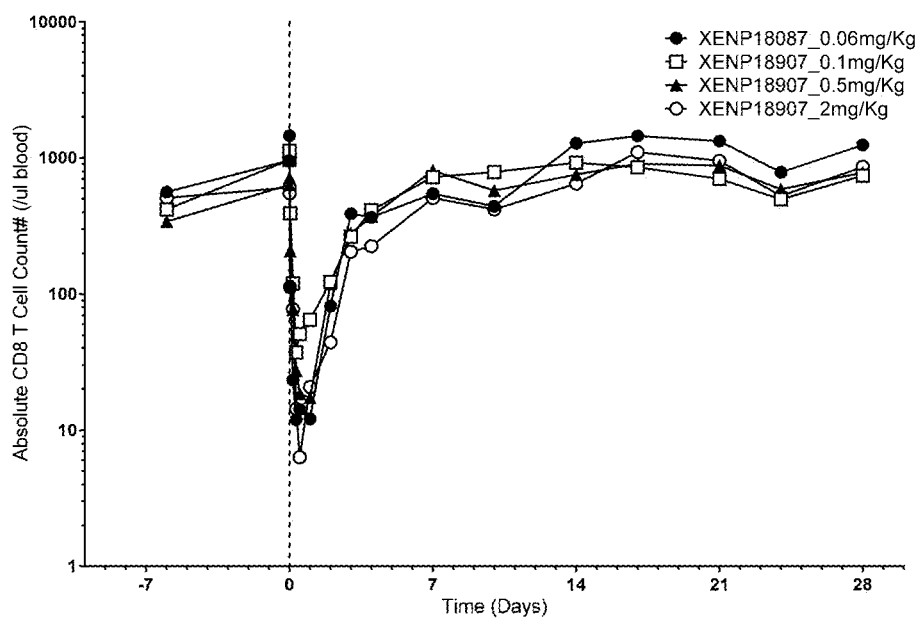

Figure 21C
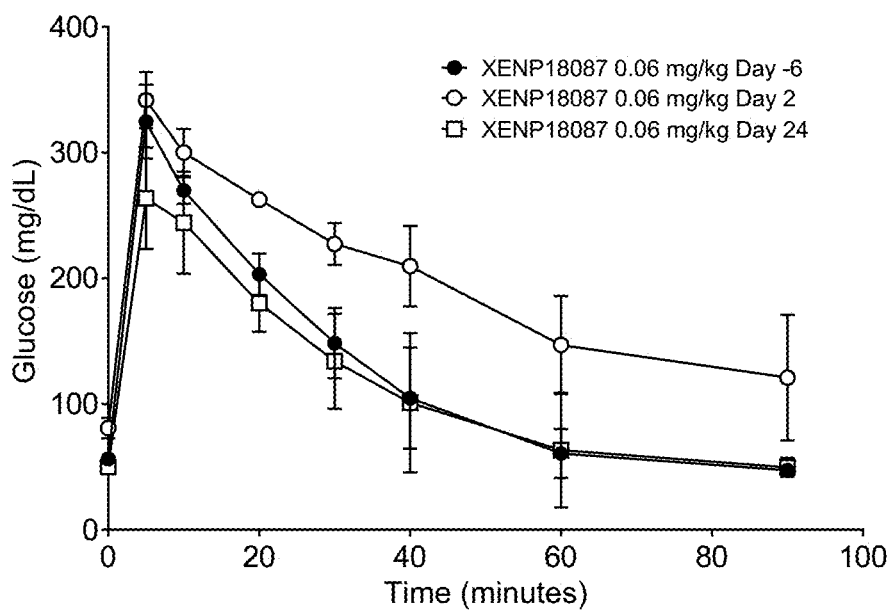
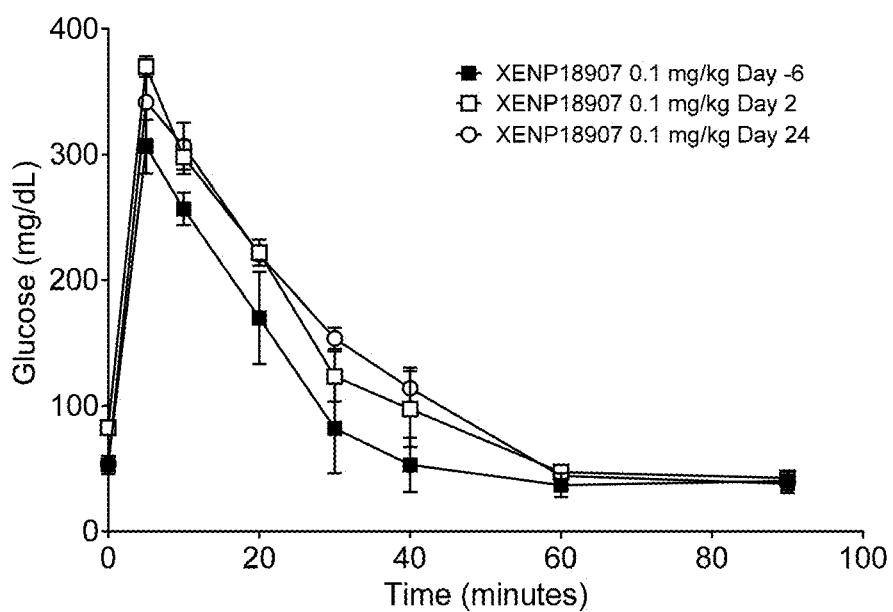

Figure 21D
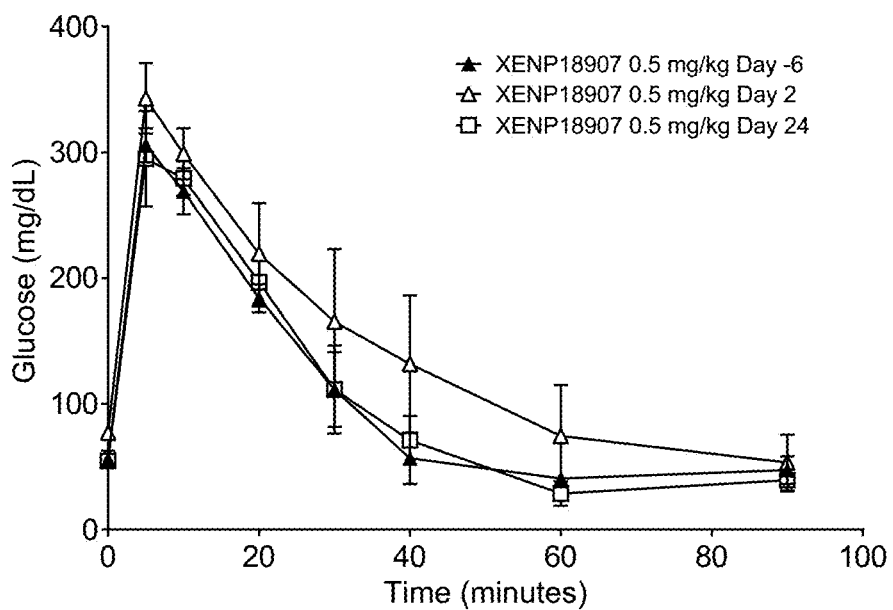
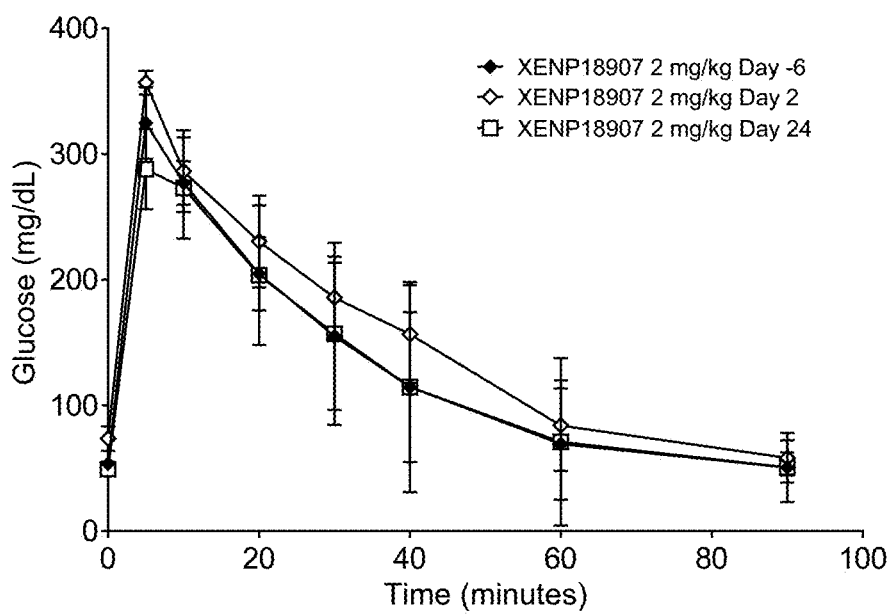

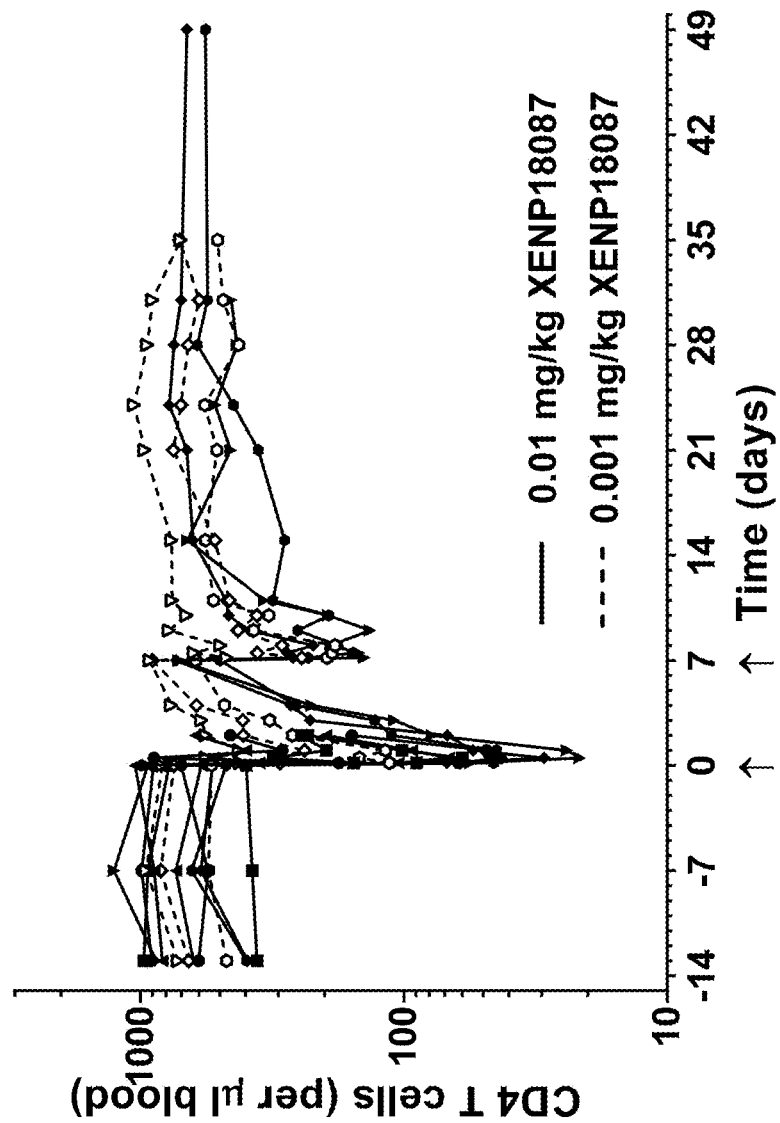

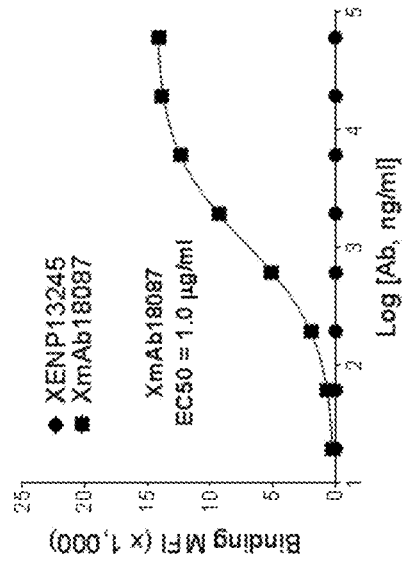
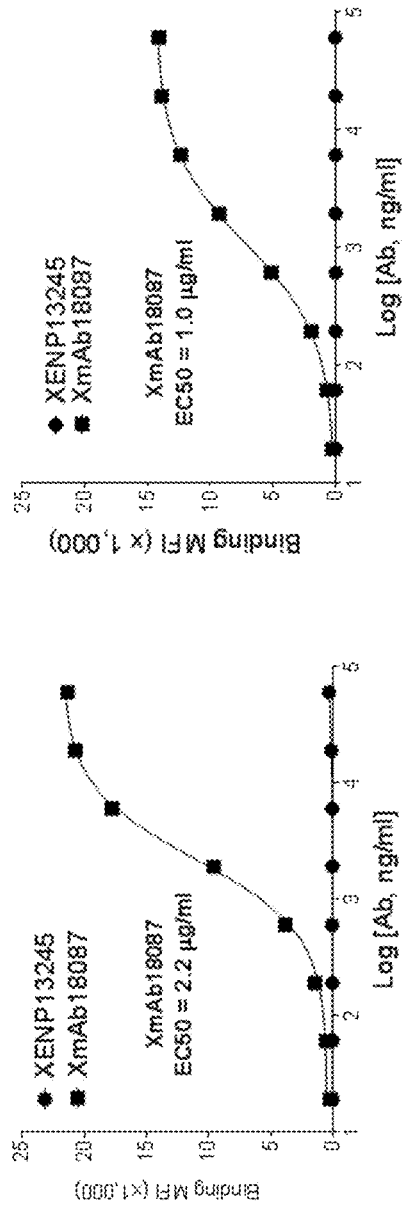
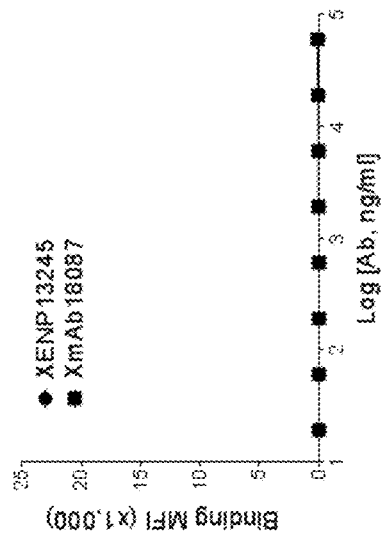

Figure 29
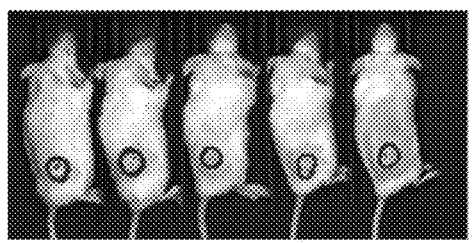 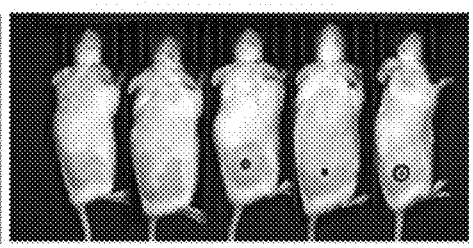

Figure 32A
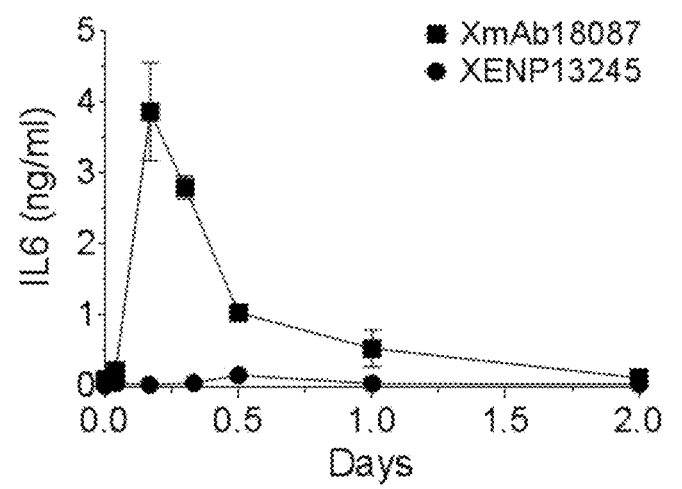
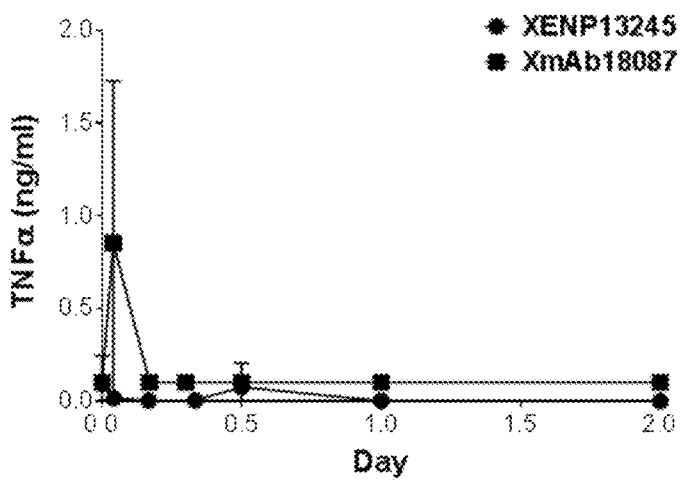
Figure 32B

HETERODIMERIC ANTIBODIES THAT BIND SOMATOSTATIN RECEPTOR 2

CROSS-REFERENCE TO RELATED APPLICATIONS

This application claims the benefit of U.S. Provisional Application Nos. 62/481,065 filed Apr. 3, 2017, 62/397,322, filed Sep. 20, 2016, 62/355,821, filed Jun. 28, 2016 and 62/355,820, filed Jun. 28, 2016, the contents of which are expressly fully incorporated by reference in their entirety.

SEQUENCE LISTING

The instant application contains a Sequence Listing which has been submitted electronically in ASCII format and is hereby incorporated by reference in its entirety. Said ASCII copy, created on Jun. 28, 2017, is named 067461-5194-WO_SL.txt and is 2,771,347 bytes in size.

BACKGROUND OF THE INVENTION

Antibody-based therapeutics have been used successfully to treat a variety of diseases, including cancer and autoimmune/inflammatory disorders. Yet improvements to this class of drugs are still needed, particularly with respect to enhancing their clinical efficacy. One avenue being explored is the engineering of additional and novel antigen binding sites into antibody-based drugs such that a single immunoglobulin molecule co-engages two different antigens. Such non-native or alternate antibody formats that engage two different antigens are often referred to as bispecifics. Because the considerable diversity of the antibody variable region (Fv) makes it possible to produce an Fv that recognizes virtually any molecule, the typical approach to bispecific generation is the introduction of new variable regions into the antibody.

A number of alternate antibody formats have been explored for bispecific targeting (Chames & Baty, 2009, mAbs 1[6]:1-9; Holliger & Hudson, 2005, Nature Biotechnology 23[9]:1126-1136; Kontermann, mAbs 4(2):182 (2012), all of which are expressly incorporated herein by reference). Initially, bispecific antibodies were made by fusing two cell lines that each produced a single monoclonal antibody (Milstein et al., 1983, Nature 305:537-540). Although the resulting hybrid hybridoma or quadroma did produce bispecific antibodies, they were only a minor population, and extensive purification was required to isolate the desired antibody. An engineering solution to this was the use of antibody fragments to make bispecifics. Because such fragments lack the complex quaternary structure of a full length antibody, variable light and heavy chains can be linked in single genetic constructs. Antibody fragments of many different forms have been generated, including diabodies, single chain diabodies, tandem scFv's, and Fab$_2$ bispecifics (Chames & Baty, 2009, mAbs 1[6]:1-9; Holliger & Hudson, 2005, Nature Biotechnology 23[9]:1126-1136; expressly incorporated herein by reference). While these formats can be expressed at high levels in bacteria and may have favorable penetration benefits due to their small size, they clear rapidly in vivo and can present manufacturing obstacles related to their production and stability. A principal cause of these drawbacks is that antibody fragments typically lack the constant region of the antibody with its associated functional properties, including larger size, high stability, and binding to various Fc receptors and ligands that maintain long half-life in serum (i.e. the neonatal Fc receptor FcRn) or serve as binding sites for purification (i.e. protein A and protein G).

More recent work has attempted to address the shortcomings of fragment-based bispecifics by engineering dual binding into full length antibody-like formats (Wu et al., 2007, Nature Biotechnology 25[11]:1290-1297; U.S. Ser. No. 12/477,711; Michaelson et al., 2009, mAbs 1[2]:128-141; PCT/US2008/074693; Zuo et al., 2000, Protein Engineering 13[5]:361-367; U.S. Ser. No. 09/865,198; Shen et al., 2006, J Biol Chem 281[16]:10706-10714; Lu et al., 2005, J Biol Chem 280[20]:19665-19672; PCT/US2005/025472; expressly incorporated herein by reference). These formats overcome some of the obstacles of the antibody fragment bispecifics, principally because they contain an Fc region. One significant drawback of these formats is that, because they build new antigen binding sites on top of the homodimeric constant chains, binding to the new antigen is always bivalent.

For many antigens that are attractive as co-targets in a therapeutic bispecific format, the desired binding is monovalent rather than bivalent. For many immune receptors, cellular activation is accomplished by cross-linking of a monovalent binding interaction. The mechanism of cross-linking is typically mediated by antibody/antigen immune complexes, or via effector cell to target cell engagement. For example, the low affinity Fc gamma receptors (FcγRs) such as FcγRIIa, FcγRIIb, and FcγRIIIa bind monovalently to the antibody Fc region. Monovalent binding does not activate cells expressing these FcγRs; however, upon immune complexation or cell-to-cell contact, receptors are cross-linked and clustered on the cell surface, leading to activation. For receptors responsible for mediating cellular killing, for example FcγRIIIa on natural killer (NK) cells, receptor cross-linking and cellular activation occurs when the effector cell engages the target cell in a highly avid format (Bowles & Weiner, 2005, J Immunol Methods 304:88-99, expressly incorporated by reference). Similarly, on B cells the inhibitory receptor FcγRIIb downregulates B cell activation only when it engages into an immune complex with the cell surface B-cell receptor (BCR), a mechanism that is mediated by immune complexation of soluble IgG's with the same antigen that is recognized by the BCR (Heyman 2003, Immunol Lett 88[2]:157-161; Smith and Clatworthy, 2010, Nature Reviews Immunology 10:328-343; expressly incorporated by reference). As another example, CD3 activation of T-cells occurs only when its associated T-cell receptor (TCR) engages antigen-loaded MHC on antigen presenting cells in a highly avid cell-to-cell synapse (Kuhns et al., 2006, Immunity 24:133-139). Indeed nonspecific bivalent cross-linking of CD3 using an anti-CD3 antibody elicits a cytokine storm and toxicity (Perruche et al., 2009, J Immunol 183 [2]:953-61; Chatenoud & Bluestone, 2007, Nature Reviews Immunology 7:622-632; expressly incorporated by reference). Thus for practical clinical use, the preferred mode of CD3 co-engagement for redirected killing of targets cells is monovalent binding that results in activation only upon engagement with the co-engaged target.

Somatostatins are neuropeptides that act as endogenous inhibitory regulators. Somatostatins have a broad range of cellular functions such as inhibition of many secretions, cell proliferation and cell survival (Patel, 1999, Front Neuroendocrinol. 20:157-198). Somatostatins are broadly distributed in the centeral nervous system, peripheral nervous system, pancreas and gut (see, e.g., Watt et al., 2008, Mol Cell Endocrinol. 286: 251-261; Epelbaum, 1986, Prog. Neurobiol. 27: 63-100; and Raynor, 1992, Crit. Rev. Neurobiol. 6:

273-289). Somatostatins are also expressed in neuroendocrine tumors (NETs), such as medullary, thyroid cancer, neuroblastoma, ganglioneuroma, glucagonmas, adenocortical tumors and tumors that appear in the lung, paraganglia, duodenum and some other non-NETs (Volante et al., 2008, Mol. Cell. Endocrinol. 286: 219-229). Somatostatins can elicit effects on target cells by directly activating somatostatin receptors (SSTRs)(Watt et al., 2008, Mol Cell Endocrinol. 286: 251-261; Pyronnet et al., 2008, Mol. Cell. Endocrinol. 286: 230-237).

Somatostatin receptors (SSTRs) belong to a superfamily of G protein-coupled receptors (GPCRs) that each contain a single polypeptide chain consisting of extracellular/intracellular domains, and seven transmembrane domains. SSTRs are highly expressed in various cultured tumor cells and primary tumor tissues, including NETs (lung, GI, pancreatic, pituitary, medullary cancers, prostate, pancreatic lungcarcinoids, osteosarcoma, etc.) as well as non-NETs (breast, lung, colarectal, ovarian, cervial cancers, etc.) (Reubi., 2003, Endocr. Rev. 24: 389-427; Volante et al., 2008, Mol. Cell. Endocrinol. 286: 219-229; and Schulz et al., 2003, Gynecol. Oncol. 89: 385-390). To date, five SSTR receptor subtypes have been identified (Patel et al., 1997, Trends Endocrinol. Metab. 8: 398-405). SSTR2 in particular is expressed at a high concentration on many tumor cells (Volante et al., 2008, Mol. Cell. Endocrinol. 286: 219-229; and Reubi et al., 2003, Eur. J. Nucl. Med. Mol. Imaging 30: 781-793), thus making it a candidate target antigen for bispecific antibody cancer target therapeutics. In view of the high concentration of SSTR2 expressed on various tumors, it is believed that anti-SSTR2 antibodies are useful, for example, for localizing anti-tumor therapeutics (e.g., chemotherapeutic agents and T cells) to such SSTR2 expressing tumors. For example, bispecific antibodies to SSTR2 and CD3 that are capable of localizing CD3+ effector T cells to SSTR2 expressing tumors are believed to be useful cancer therapeutics. While bispecifics generated from antibody fragments suffer biophysical and pharmacokinetic hurdles, a drawback of those built with full length antibody-like formats is that they engage co-target antigens multivalently in the absence of the primary target antigen, leading to nonspecific activation and potentially toxicity. The present invention solves this problem by introducing novel bispecific antibodies directed to SSTR2 and CD3.

BRIEF SUMMARY OF THE INVENTION

Accordingly, provided herein are somatostatin receptor 2 (SSTR2) antigen binding domains and anti-SSTR2 antibodies (e.g., bispecific antibodies).

In one aspect, provided herein are SSTR2 "bottle opener" format antibodies that include: a) a first heavy chain that includes i) a first variant Fc domain; and ii) a single chain Fv region (scFv), where the scFv region includes a first variable heavy domain, a first variable light domain and a charged scFv linker, where the charged scFv linker covalently attaches the first variable heavy domain and the first variable light domain; b) a second heavy chain that includes a VH-CH1-hinge-CH2-CH3 monomer, where VH is a second variable heavy domain and CH2-CH3 is a second variant Fc domain; and c) a light chain that includes a second variable light domain and a light constant domain. The second variant Fc domain includes amino acid substitutions N208D/Q295E/N384D/Q418E/N421D, the first and second variant Fc domains each include amino acid substitutions E233P/L234V/L235A/G236del/S267K; the first variant Fc domain includes amino acid substitutions S364K/E357Q and the second variant Fc domain the amino acid substitutions L368D/K370S. Further, the second variable heavy domain includes SEQ ID NO: 1071 and the second variable light domain includes SEQ ID NO: 1076, where numbering is according to the EU index as in Kabat.

In certain embodiments of the SSTR2 "bottle opener" format antibodies, the scFv binds CD3. In some embodiments, the first variable heavy domain and the first variable light domain are selected from the sets comprising: SEQ ID NO: 1 and SEQ ID NO: 5; SEQ ID NO: 10 and SEQ ID NO: 14; SEQ ID NO: 19 and SEQ ID NO: 23; SEQ ID NO: 28 and SEQ ID NO: 32; SEQ ID NO: 37 and SEQ ID NO: 41; and SEQ ID NO: 46 and SEQ ID NO: 50, respectively. In some embodiments, the first variable heavy domain includes SEQ ID NO: 1 and the first variable light domain includes SEQ ID NO: 5.

In certain embodiments of the SSTR2 "bottle opener" format antibodies, the CH1-hinge-CH2-CH3 component of the second heavy chain includes SEQ ID NO: 1108, the first variant Fc domain includes SEQ ID NO: 1109 and the constant light domain includes SEQ ID NO: 1110.

In some embodiments, the first heavy chain includes SEQ ID NO: 1080, the second heavy chain includes SEQ ID NO: 1070, and the light chain includes SEQ ID NO: 1075.

In another aspect provided herein is a somatostatin receptor type 2 (SSTR2) antigen binding domain, that includes a variable heavy domain having SEQ ID NO: 958 and a variable light domain having SEQ ID NO: 962.

In another aspect, provided herein is a nucleic acid composition that includes nucleic acids encoding any of the heterodimeic antibodies or antigen binding domains described herein.

In yet another aspect, provided herein is an expression vector that includes any of the nucleic acids described herein.

In one aspect, provided herein is a host cell transformed with any of the expression vectors or nucleic acids described herein.

In another aspect, provided herein is a method of making a subject heterodimeric antibody or antigen binding domain described herein. The method includes a step of culturing a host cell transformed with any of the expression vectors or nucleic acids described herein under conditions wherein the antibody or antigen binding domain is expressed, and recovering the antibody or antigen binding domain.

In one aspect, provided herein is a method of treating cancer that includes administering to a patient in need thereof any one of the subject antibodies described herein. In some embodiments, the cancer is a neuroendocrine cancer.

BRIEF DESCRIPTION OF THE DRAWINGS

FIG. 2 depicts the amino acid sequences for human and Cynomolgus monkey (*Macaca fascicularis*) SSTR2 protein.

FIG. 3A-3F depict useful pairs of heterodimerization variant sets (including skew and pI variants). On FIG. 3F, there are variants for which there are no corresponding "monomer 2" variants; these are pI variants which can be used alone on either monomer, or included on the Fab side of a bottle opener, for example, and an appropriate charged scFv linker can be used on the second monomer that utilizes a scFv as the second antigen binding domain. Suitable charged linkers are shown in FIGS. 7A and B.

FIG. 4 depicts a list of isosteric variant antibody constant regions and their respective substitutions. pI_(−) indicates lower pI variants, while pI_(+) indicates higher pI variants. These can be optionally and independently combined with other heterodimerization variants of the invention (and other variant types as well, as outlined herein).

FIG. 5 depict useful ablation variants that ablate FcγR binding (sometimes referred to as "knock outs" or "KO" variants).

FIG. 6 show two particularly useful embodiments of the invention.

FIGS. 7A-7B depict a number of charged scFv linkers that find use in increasing or decreasing the pI of the subject heterodimeric antibodies that utilize one or more scFv as a component, as described herein. The (+H) positive linker finds particular use herein, particularly with anti-CD3 vl and vh sequences shown herein. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs.

FIG. 8 depicts various heterodimeric skewing variant amino acid substitutions that can be used with the heterodimeric antibodies described herein.

FIG. 9A-9E shows the sequences of several useful bottle opener format backbones based on human IgG1, without the Fv sequences (e.g. the scFv and the vh and vl for the Fab side). Bottle opener backbone 1 is based on human IgG1 (356E/358M allotype), and includes the S364K/E357Q: L368D/K370S skew variants, the N208D/Q295E/N384D/ Q418E/N421D pI variants on the Fab side and the E233P/ L234V/L235A/G236del/S267K ablation variants on both chains. Bottle opener backbone 2 is based on human IgG1 (356E/358M allotype), and includes different skew variants, the N208D/Q295E/N384D/Q418E/N421D pI variants on the Fab side and the E233P/L234V/L235A/G236del/S267K ablation variants on both chains. Bottle opener backbone 3 is based on human IgG1 (356E/358M allotype), and includes different skew variants, the N208D/Q295E/N384D/ Q418E/N421D pI variants on the Fab side and the E233P/ L234V/L235A/G236del/S267K ablation variants on both chains. Bottle opener backbone 4 is based on human IgG1 (356E/358M allotype), and includes different skew variants, the N208D/Q295E/N384D/Q418E/N421D pI variants on the Fab side and the E233P/L234V/L235A/G236del/S267K ablation variants on both chains. Bottle opener backbone 5 is based on human IgG1 (356D/358L allotype), and includes the S364K/E357Q:L368D/K370S skew variants, the N208D/Q295E/N384D/Q418E/N421D pI variants on the Fab side and the E233P/L234V/L235A/G236del/S267K ablation variants on both chains. Bottle opener backbone 6 is based on human IgG1 (356E/358M allotype), and includes the S364K/E357Q:L368D/K370S skew variants, the N208D/Q295E/N384D/Q418E/N421D pI variants on the Fab side and the E233P/L234V/L235A/G236del/S267K ablation variants on both chains, as well as an N297A variant on both chains. Bottle opener backbone 7 is identical to 6 except the mutation is N297S. Alternative formats for bottle opener backbones 6 and 7 can exclude the ablation variants E233P/L234V/L235A/G236del/S267K in both chains. Backbone 8 is based on human IgG4, and includes the S364K/E357Q:L368D/K370S skew variants, the N208D/ Q295E/N384D/Q418E/N421D pI variants on the Fab side and the E233P/L234V/L235A/G236del/S267K ablation variants on both chains, as well as a S228P (EU numbering, this is S241P in Kabat) variant on both chains that ablates Fab arm exchange as is known in the art. Alternative formats for bottle opener backbone 8 can exclude the ablation variants E233P/L234V/L235A/G236del/S267K in both chains. Backbone 9 is based on human IgG2, and includes the S364K/E357Q:L368D/K370S skew variants, the N208D/Q295E/N384D/Q418E/N421D pI variants on the Fab side. Backbone 10 is based on human IgG2, and includes the S364K/E357Q:L368D/K370S skew variants, the N208D/Q295E/N384D/Q418E/N421D pI variants on the Fab side as well as a S267K variant on both chains.

As will be appreciated by those in the art and outlined below, these sequences can be used with any vh and vl pairs outlined herein, with one monomer including a scFv (optionally including a charged scFv linker) and the other monomer including the Fab sequences (e.g. a vh attached to the "Fab side heavy chain" and a vl attached to the "constant light chain"). That is, any Fv sequences outlined herein for anti-SSTR2 and anti-CD3, whether as scFv (again, optionally with charged scFv linkers) or as Fabs, can be incorporated into these FIG. 9 backbones in any combination. The constant light chain depicted in FIG. 9A can be used for all of the constructs in the figure, although the kappa constant light chain can also be substituted.

Figures 1A, 1B, 1C, 1D, 1E:
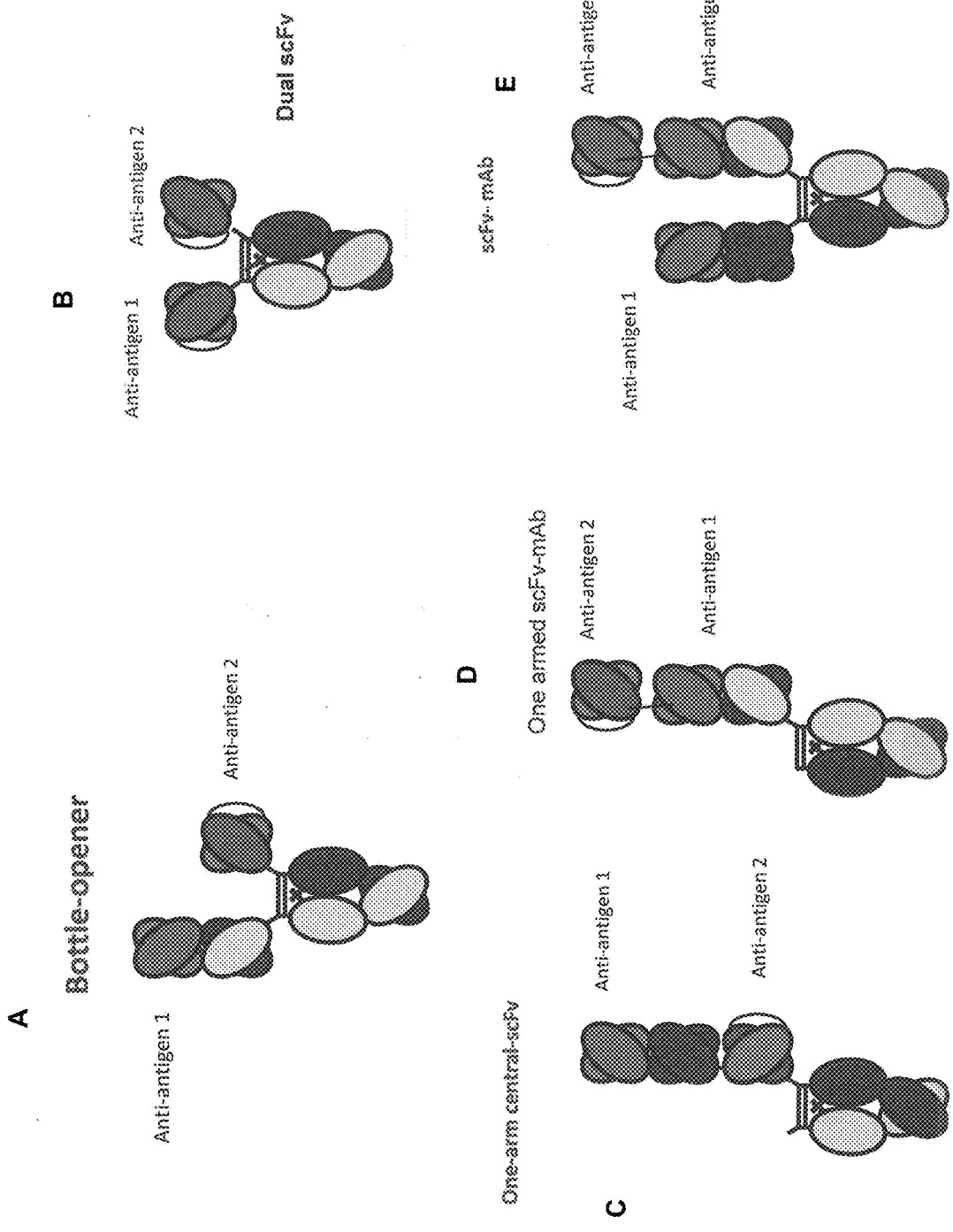
FIG. 1A-1I depict several formats of the present invention. The first is the "bottle opener" format, with a first and a second anti-antigen binding domain. Additionally, mAb-Fv, mAb-scFv, Central-scFv, Central-Fv, one armed central-scFv, one scFv-mAb, scFv-mAb and a dual scFv format are all shown. For all of the scFv domains depicted, they can be either N- to C-terminus variable heavy-(optional linker)-variable light, or the opposite. In addition, for the one armed scFv-mAb, the scFv can be attached either to the N-terminus of a heavy chain monomer or to the N-terminus of the light chain. In certain embodiments, "Anti-antigen 1" in FIG. 1 refers to an anti-SSTR2 binding domain. In certain embodiments "Anti-antigen 1" in FIG. 1 refers to an anti-CD3 binding domain. In certain embodiments, "Anti-antigen 2" in FIG. 1 refers to an anti-SSTR2 binding domain. In certain embodiments "Anti-antigen2" in FIG. 1 refers to an anti-CD3 binding domain. In some embodiments, "Anti-antigen 1" in FIG. 1 refers to an anti-SSTR2 binding domain and "Anti-antigen 2" in FIG. 1 refers to an anti-CD3 binding domain. In some embodiments, "Anti-antigen 1" in FIG. 1 refers to an anti-CD3 binding domain and "Anti-antigen 2" in FIG. 1 refers to an anti-SSTR2 binding domain.
Figures 1F, 1G, 1H, 1I:
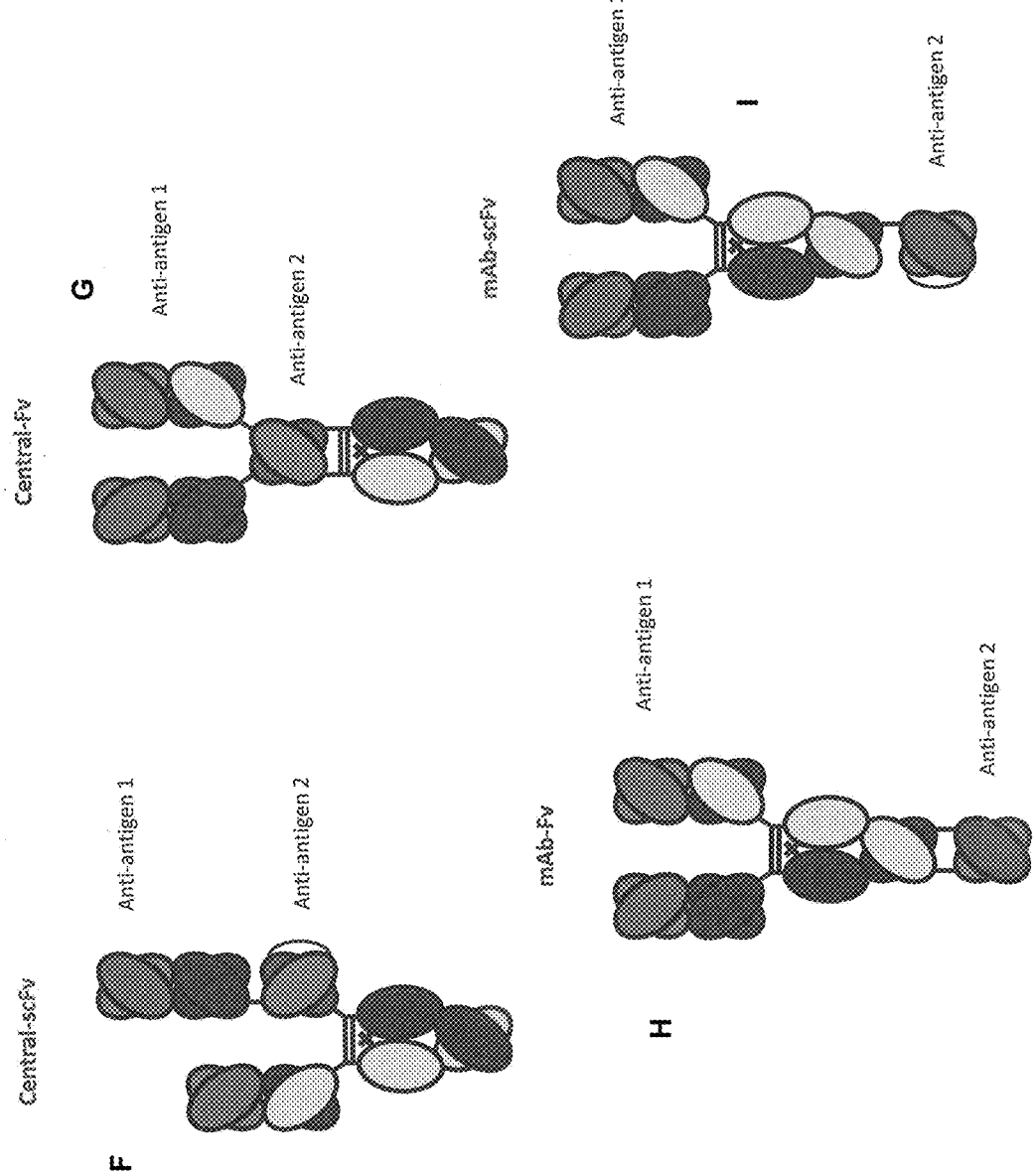

It should be noted that these bottle opener backbones find use in the Central-scFv format of FIG. 1F, where an additional, second Fab (vh-CH1 and vl-constant light) with the same antigen binding as the first Fab is added to the N-terminus of the scFv on the "bottle opener side".

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 10A-10D shows the sequences of a mAb-scFv backbone of use in the invention, to which the Fv sequences of the invention are added. mAb-scFv backbone 1 is based on human IgG1 (356E/358M allotype), and includes the S364K/E357Q:L368D/K370S skew variants, the N208D/ Q295E/N384D/Q418E/N421D pI variants on the Fab side and the E233P/L234V/L235A/G236del/S267K ablation variants on both chains. Backbone 2 is based on human IgG1 (356D/358L allotype), and includes the S364K/E357Q: L368D/K370S skew variants, the N208D/Q295E/N384D/

Q418E/N421D pI variants on the Fab side and the E233P/L234V/L235A/G236del/S267K ablation variants on both chains. Backbone 3 is based on human IgG1 (356E/358M allotype), and includes the S364K/E357Q:L368D/K370S skew variants, N208D/Q295E/N384D/Q418E/N421D pI variants on the Fab side and the E233P/L234V/L235A/G236del/S267K ablation variants on both chains, as well as an N297A variant on both chains. Backbone 4 is identical to 3 except the mutation is N297S. Alternative formats for mAb-scFv backbones 3 and 4 can exclude the ablation variants E233P/L234V/L235A/G236del/S267K in both chains. Backbone 5 is based on human IgG4, and includes the S364K/E357Q:L368D/K370S skew variants, the N208D/Q295E/N384D/Q418E/N421D pI variants on the Fab side and the E233P/L234V/L235A/G236del/S267K ablation variants on both chains, as well as a S228P (EU numbering, this is S241P in Kabat) variant on both chains that ablates Fab arm exchange as is known in the art Backbone 6 is based on human IgG2, and includes the S364K/E357Q:L368D/K370S skew variants, the N208D/Q295E/N384D/Q418E/N421D pI variants on the Fab side. Backbone 7 is based on human IgG2, and includes the S364K/E357Q: L368D/K370S skew variants, the N208D/Q295E/N384D/Q418E/N421D pI variants on the Fab side as well as a S267K variant on both chains.

As will be appreciated by those in the art and outlined below, these sequences can be used with any vh and vl pairs outlined herein, with one monomer including both a Fab and an scFv (optionally including a charged scFv linker) and the other monomer including the Fab sequence (e.g. a vh attached to the "Fab side heavy chain" and a vl attached to the "constant light chain"). That is, any Fv sequences outlined herein for anti-SSTR2 and anti-CD3, whether as scFv (again, optionally with charged scFv linkers) or as Fabs, can be incorporated into this FIG. 10 backbone in any combination. The monomer 1 side is the Fab-scFv pI negative side, and includes the heterodimerization variants L368D/K370S, the isosteric pI variants N208D/Q295E/N384D/Q418E/N421D, the ablation variants E233P/L234V/L235A/G236del/S267K, (all relative to IgG1). The monomer 2 side is the scFv pI positive side, and includes the heterodimerization variants 364K/E357Q. However, other skew variant pairs can be substituted, particularly [S364K/E357Q:L368D/K370S]; [L368D/K370S:S364K]; [L368E/K370S:S364K]; [T411T/E360E/Q362E:D401K]; [L368D/K370S:S364K/E357L], [K370S:S364K/E357Q], [T366S/L368A/Y407V:T366W] and [T366S/L368A/Y407V/Y394C:T366W/S354C].

The constant light chain depicted in FIG. 10A can be used for all of the constructs in the figure, although the kappa constant light chain can also be substituted.

It should be noted that these mAb-scFv backbones find use in the both the mAb-Fv format of FIG. 1H (where one monomer comprises a vl at the C-terminus and the other a vh at the C-terminus) as well as the scFv-mAb format of FIG. 1E (with a scFv domain added to the C-terminus of one of the monomers).

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIGS. 11A-11G depict the amino acid sequences of exemplary subject anti-SSTR2 antigen binding domains described herein, including anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; anti-SSTR2 H1.125_L1.108; anti-SSTR2 H1.125_L1.111; anti-SSTR2 H1.125_L1.114; anti-SSTR2 H1.125_L1.102; and anti-SSTR2 H1.125_L1.10. Sequences depicted include variable heavy (vh) domains and variable light (vl) domain sequences for each antigen binding domain. For each vh sequence, vhCDR1, vhCDR2, and vhCDR3 sequences are underlined and in blue. For each vl sequence, vlCDR1, vlCDR2, and vlCDR3 sequences are underlined and in blue. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format.

FIGS. 12A-12F depict various anti-CD3 antigen binding domains (e.g., anti-CD3 scFvs) that can be used in the subject antibodies provided herein. The CDRs are underlined, the scFv linker is double underlined (in the sequences, the scFv linker is a positively charged scFv (GKPGS)4 linker, although as will be appreciated by those in the art, this linker can be replaced by other linkers, including uncharged or negatively charged linkers, some of which are depicted in FIG. 7. As above, the naming convention illustrates the orientation of the scFv from N- to C-terminus; in the sequences listed in this figure, they are all oriented as vh-scFv linker-vl (from N- to C-terminus), although these sequences may also be used in the opposite orientation, (from N- to C-terminus) vl-linker-vh. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format.

FIG. 12A depicts the sequences of the "High CD3" anti-CD3_H1.30_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 12B depicts the sequences of the "High-Int #1" Anti-CD3_H1.32_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 12C depicts the sequences of the "High-Int #2" Anti-CD3_H1.89_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 12D depicts the sequences of the "High-Int #3" Anti-CD3_H1.90_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 12E depicts the sequences of the "Int" Anti-CD3_H1.33_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 12F depicts the sequences of the "Low" Anti-CD3_H1.31_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIGS. 13A-13Z depict amino acid sequences of stability-optimized, humanized anti-CD3 variant scFvs variants that can be used with the subject bispecific antibodies described herein (e.g, anti-SSTR2X anti-CD3 "bottle opener" antibodies). CDRs are underlined. For each heavy chain/light chain combination, four sequences are listed: (i) scFv with C-terminal 6×His tag, (ii) scFv alone, (iii) VH alone, (iv) VL alone. As noted herein and is true for every sequence herein containing CDRs, the exact identification of the CDR locations may be slightly different depending on the numbering used as is shown in Table 1, and thus included herein are not only the CDRs that are underlined but also CDRs included within the vh and vl domains using other numbering systems. Furthermore, as for all the sequences in the Figures, these vh and vl sequences can be used either in a scFv format or in a Fab format.

FIGS. 14A-14B depict the amino acid sequences of an exemplary anti-SSTR2×anti-CD3 "bottle-opener" bispecific antibody described herein, XENP018087 (SSTR2 H1.143_L1.30 and CD3 H1.30_L1.47). For the SSTR2 Fab-Fc heavy chain sequence, vhCDRs1-3 are underlined and in blue and the border between the variable heavy domain and CH1-hinge-CH2-CH3 is indicated by by "/". For the CD3 scFv-Fc heavy chain sequence, borders between various domains are indicated using "/" and are as follows: scFv variable heavy chain domain/scFv linker/scFv light chain domain/Fc domain. vhCDRs1-3 and vlCDRs1-3 are underlined in blue. For each scFv-Fc domain, the vhCDR1-3 and vlCDR1-3 sequences are underlined and in blue. For the CD3 light chain sequence, vlCDRs1-3 are underlined and in blue and the border between the variable light chain domain and the light chain constant domain is indicated by "/". The charged linker depicted is (GKPGS)$_4$, although other charged or uncharged linkers can be used, such as those depicted in FIGS. 7A and B. In addition, each sequence outlined herein can include or exclude the M428L/N434S variants in one or preferably both Fc domains, which results in longer half-life in serum.

FIGS. 15A-15R depict the amino acid sequences of additional exemplary anti-SSTR2×anti-CD3 "bottle-opener" bispecific antibody described herein, including XENP018907 (FIGS. 15 A and B, SSTR2 H1.143_L1.30 and CD3 H1.32_L1.47). For the SSTR2 Fab-Fc heavy chain sequence, vhCDRs1-3 are underlined and in blue and the border between the variable heavy domain and CH1-hinge-CH2-CH3 is indicated by by "/". For the CD3 scFv-Fc heavy chain sequence, borders between various domains are indicated using "/" and are as follows: scFv variable heavy chain domain/scFv linker/scFv light chain domain/Fc domain. vhCDRs1-3 and vlCDRs1-3 are underlined in blue. For each scFv-Fc domain, the vhCDR1-3 and vlCDR1-3 sequences are underlined and in blue. For the CD3 light chain sequence, vlCDRs1-3 are underlined and in blue and the border between the variable light chain domain and the light chain constant domain is indicated by "/". The charged linker depicted is (GKPGS)$_4$, although other charged or uncharged linkers can be used, such as those depicted in FIGS. 7A and B. In addition, each sequence outlined herein can include or exclude the M428L/N434S variants in one or preferably both Fc domains, which results in longer half-life in serum.

FIGS. 16A-16C depict matrices of possible combinations for exemplary bispecific anti-SSTR2×anti-CD3 antibodies described herein. An "A" means that the CDRs of the referenced CD3 binding domain sequences at the top of the matrix can be combined with the CDRs of the SSTR2 binding domain sequences listed on the left hand side of the matrix. For example, with respect to "Anti-SSTR2 H1.143_L1.30" and "Anti-CD3 H1.30_L1.47", "A" indicates a bispecific antibody that includes a) a CD3 binding domain having vhCDRs from the variable heavy chain CD3 H1.30 sequence and the vlCDRs from the variable light chain CD3 L1.47 sequence, and b) an SSTR2 binding domain having the vhCDRs from the SSTR2 H1.143 sequence and the vlCDRs from the SSTR2 L1.30 sequence. A "B" means that the CDRs from the CD3 binding domain constructs can be combined with the variable heavy and light domains from the SSTR2 binding domain constructs. For example, with respect to "Anti-SSTR2 H1.143_L1.30" and "Anti-CD3 H1.30_L1.47", "B" indicates a bispecific antibody that includes a) a CD3 binding domain having the vhCDRs from the variable heavy chain CD3 H1.30 sequence and the vlCDRs from the variable light chain of CD3 L1.47 sequence, and b) a SSTR2 binding domain having the variable heavy domain SSTR2 H1.143 sequence and the variable light domain SSTR2 L1.30 sequence. A "C" indicates a bispecific antibody that includes a) a CD3 binding domain having a variable heavy domain and variable light domain from the anti-CD3 sequences, and b) a SSTR2 binding domain with the CDRs of the anti-SSTR2 sequences. A "D" indicates a bispecific antibody that includes an SSTR2 binding domain having the variable heavy and variable light chain of the indicated anti-SSTR2 sequence and a CD3 binding domain having the variable heavy and variable light chain of the indicated anti-CD3 sequence. An "E" indicates a bispecific antibody that includes an scFv, where the scFv of the CD3 is used with the CDRs of the SSTR2. An "F" indicates a bispecific antibody that includes an scFv, where the scFv of the CD3 is used with the variable heavy and variable light domains of the SSTR2 antigen binding domain. All of these combinations can be done in bottle opener formats, for example with any of the backbone formats shown in FIG. 9, or in alternative formats, such as mAb-Fv, mAb-scFv, Central-scFv, Central-Fv or dual scFv formats of FIG. 1, including the format backbones shown in FIG. 26. For example, "A"s (CD3 CDRs and SSTR2 CDRs) can be added to bottle opener sequences, including those of FIG. 9 or inclusive of different heterodimerization variants, or into a mAb-scFv backbone of FIG. 10, a central-scFv, a mAb-Fv format or a central-Fv format. In general, however, formats that would include bivalent binding of CD3 are disfavored.

FIGS. 16D-16F depict matrices of possible combinations for exemplary bispecific anti-SSTR2×anti-CD3 bottle opener format combinations described herein. In these matrices, the anti-CD3 scFvs are listed in the X axis and the anti-SSTR2 Fabs are listed on the Y axis. An "A" means that the CDRs of the referenced CD3 binding domain sequences at the top of the matrix can be combined with the CDRs of the SSTR2 binding domain sequences listed on the left hand side of the matrix. For example, with respect to "Anti-SSTR2 H1.143_L1.30" and "Anti-CD3 H1.30_L1.47", "A" indicates a bispecific bottle opener format antibody that includes a) an anti-CD3 scFV having vhCDRs from the variable heavy chain CD3 H1.30 sequence and the vlCDRs from the variable light chain CD3 L1.47 sequence, and b) an anti-SSTR2 Fab having the vhCDRs from the SSTR2 H1.143 sequence and the vlCDRs from the SSTR2 L1.30 sequence. A "B" means that the CDRs from the CD3 binding domain constructs can be combined with the variable heavy and light domains from the SSTR2 binding domain constructs. For example, with respect to "Anti-SSTR2 H1.143_L1.30" and "Anti-CD3 H1.30_L1.47", "B" indicates a bispecific bottle opener antibody that includes a) a anti-CD3 scFv having the vhCDRs from the variable heavy chain CD3 H1.30 sequence and the vlCDRs from the variable light chain of CD3 L1.47 sequence, and b) an anti-SSTR2 Fab having the variable heavy domain SSTR2 H1.143 sequence and the variable light domain SSTR2 L1.30 sequence. A "C" indicates a bispecific bottle opener antibody that includes a) anti-CD3 scFv having a variable heavy domain and variable light domain from the anti-CD3 sequences, and b) a SSTR2 Fab with the CDRs of the anti-SSTR2 sequences. A "D" indicates a bispecific bottle opener antibody that includes an an anti-SSTR2 Fab having the variable heavy and variable light chain of the indicated SSTR2 sequence and an anti-CD3 scFv having the variable heavy and variable light chain of the indicated anti-CD3 sequence.

Figure 17A:
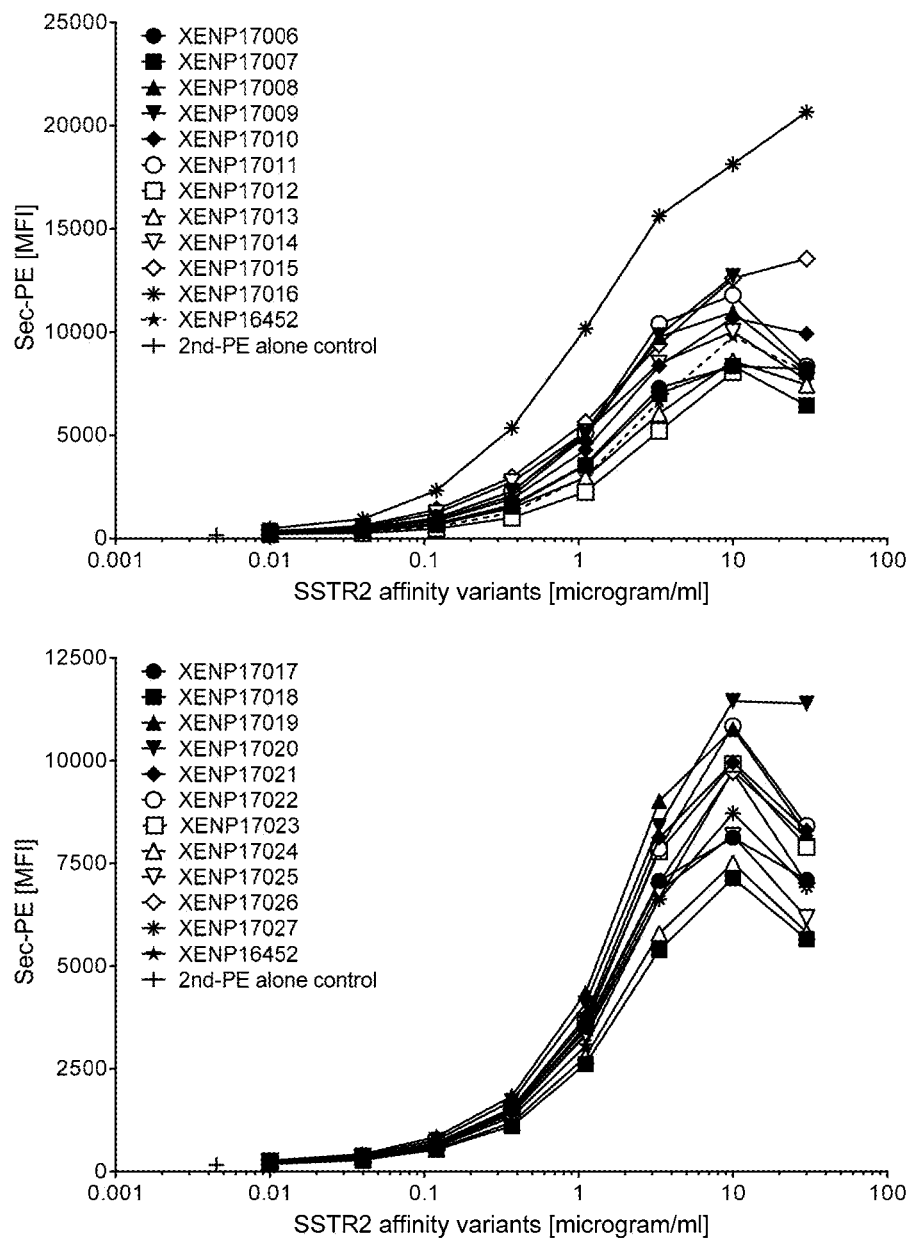
Figure 17F:
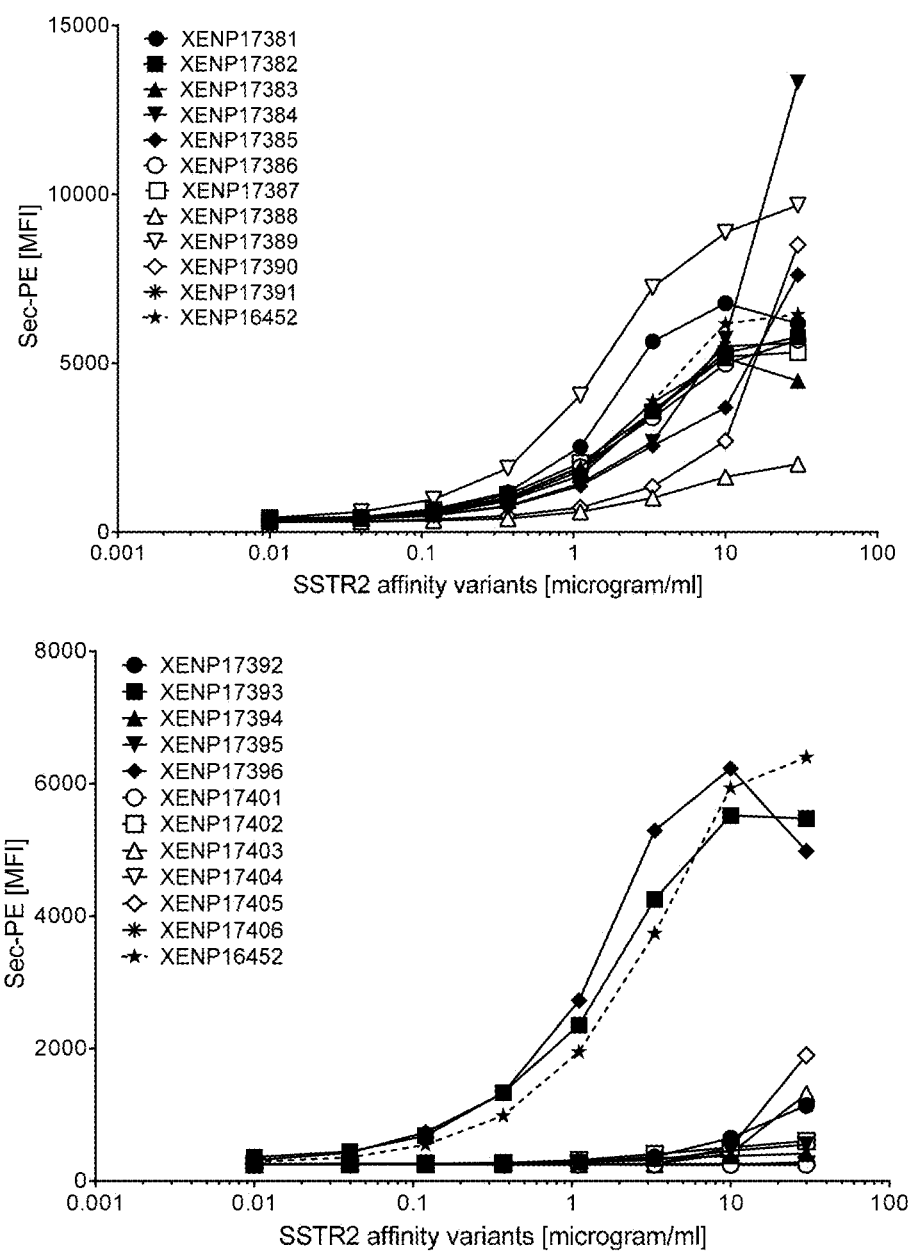

FIGS. 17A-17P depict cell surface binding assays of exemplary anti-SSTR2 antibodies and anti-SSTR2×anti-CD3 bispecific antibodies using human SSTR2 transfected CHO cells. Binding was measured by flow cytometry using phycoerythrin (PE) labeled secondary antibody.

FIGS. 18A-18D depict results of redirected T cell cytotoxicity (RTCC) assay, using anti-SSTR2×anti-CD3 bispecifics and human SSTR2 transfected CHO cells.

Figure 19C:
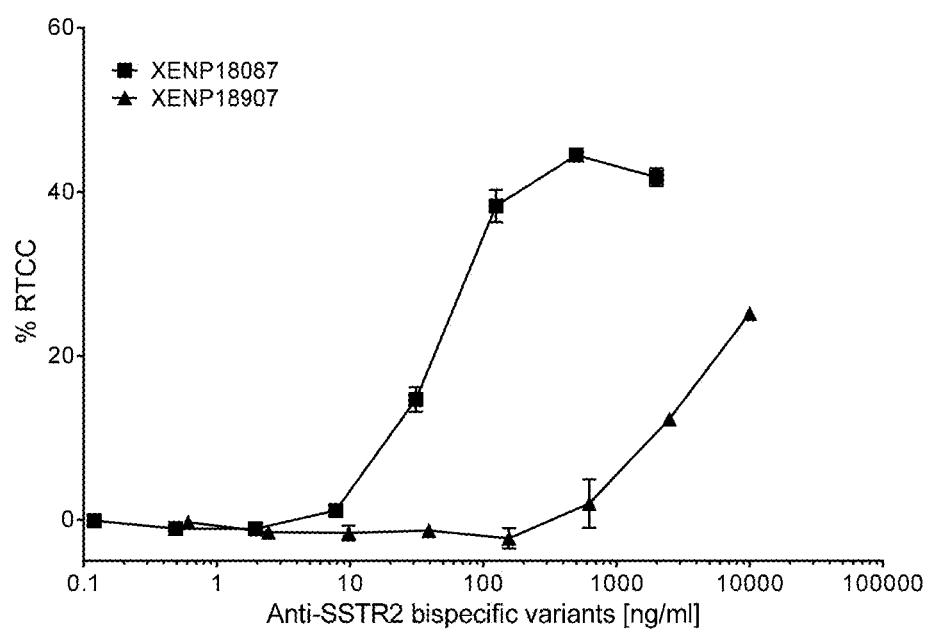

FIGS. 19A-19C depict the results of redirected T cell cytotoxicity (RTCC) assay, using anti-SSTR2×anti-CD3 bispecifics with TT cells (human thyroid medullary carcinoma cell line, FIGS. 19A-19C).

Figure 20B:
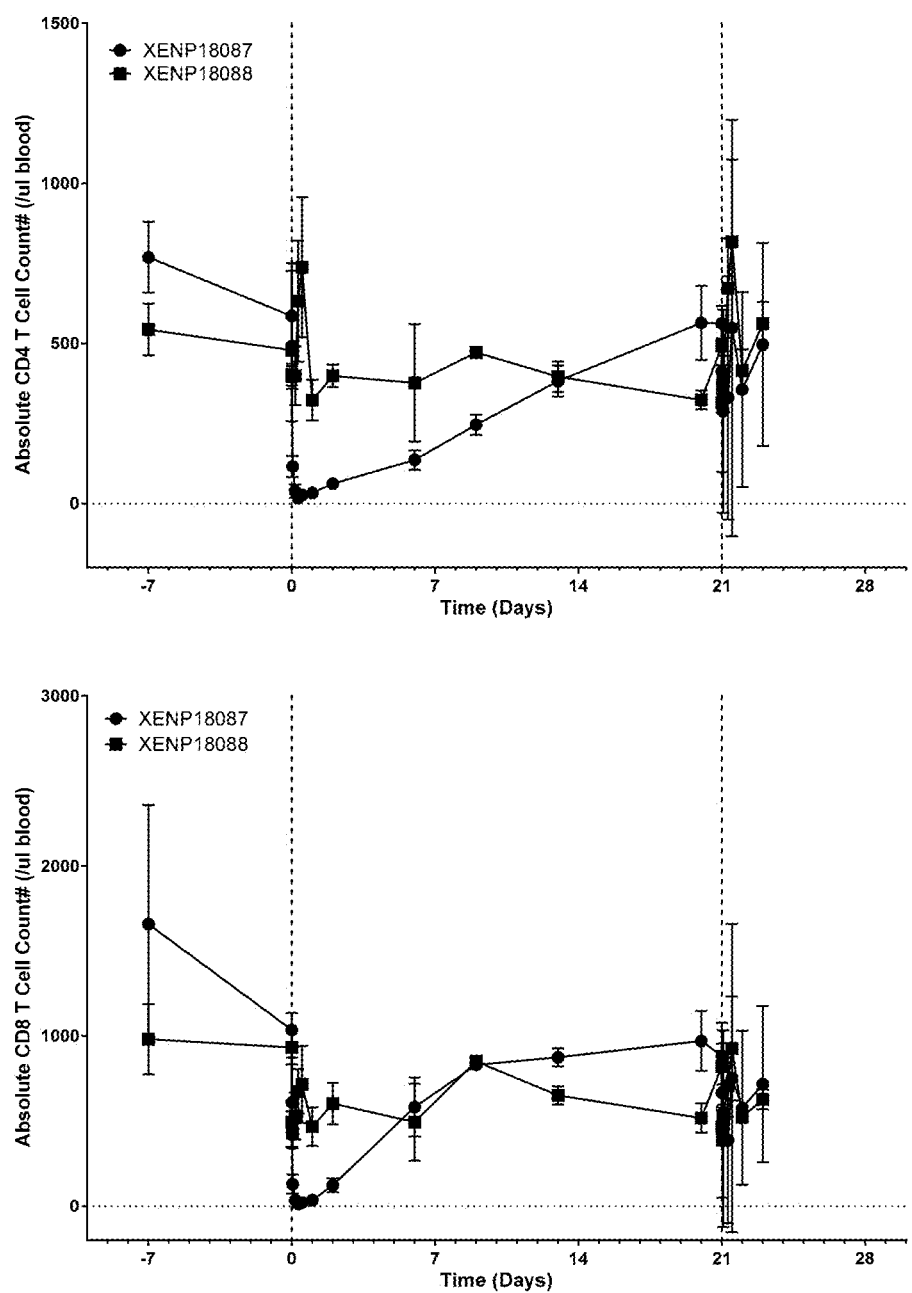

FIGS. 20A-20B depict a study of the effects of anti-SSTR2×anti-CD3 bispecific antibodies on CD4$^+$ and CD8$^+$ T cell activation (FIG. 20A) and CD4$^+$ and CD8$^+$ T cell distribution (FIG. 20B) in cynomolgus monkeys.

FIGS. 21A-21D depict additional studies of the effects of anti-SSTR2×anti-CD3 bispecific antibodies on CD4$^+$ and CD8$^+$ T cell activation (FIG. 21A) and CD4$^+$ + and CD8++ T cell distribution (FIG. 21B) in cynomolgus monkeys. In addition, a glucose tolerance test (GTT) was conducted (FIGS. 21C and 21D) to assess the ability of the tested subjects to breakdown glucose.

Figure 22A:
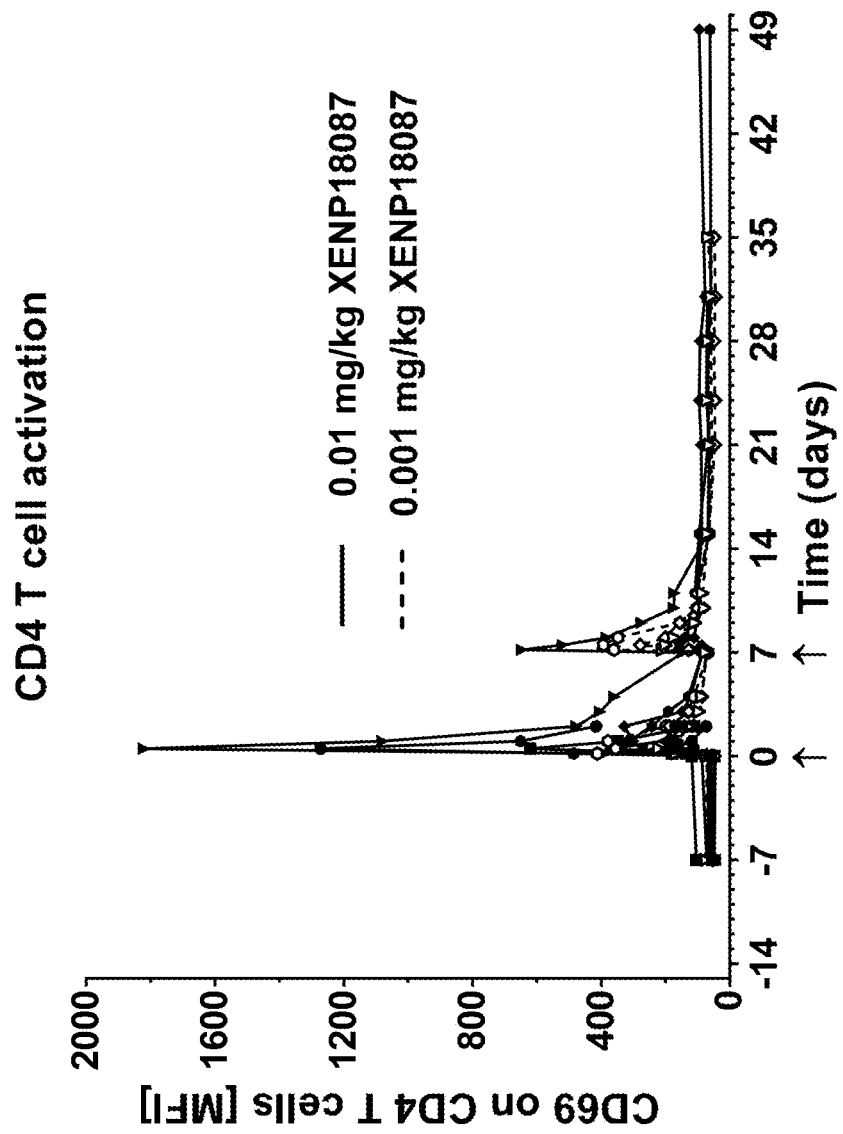
Figure 22B:
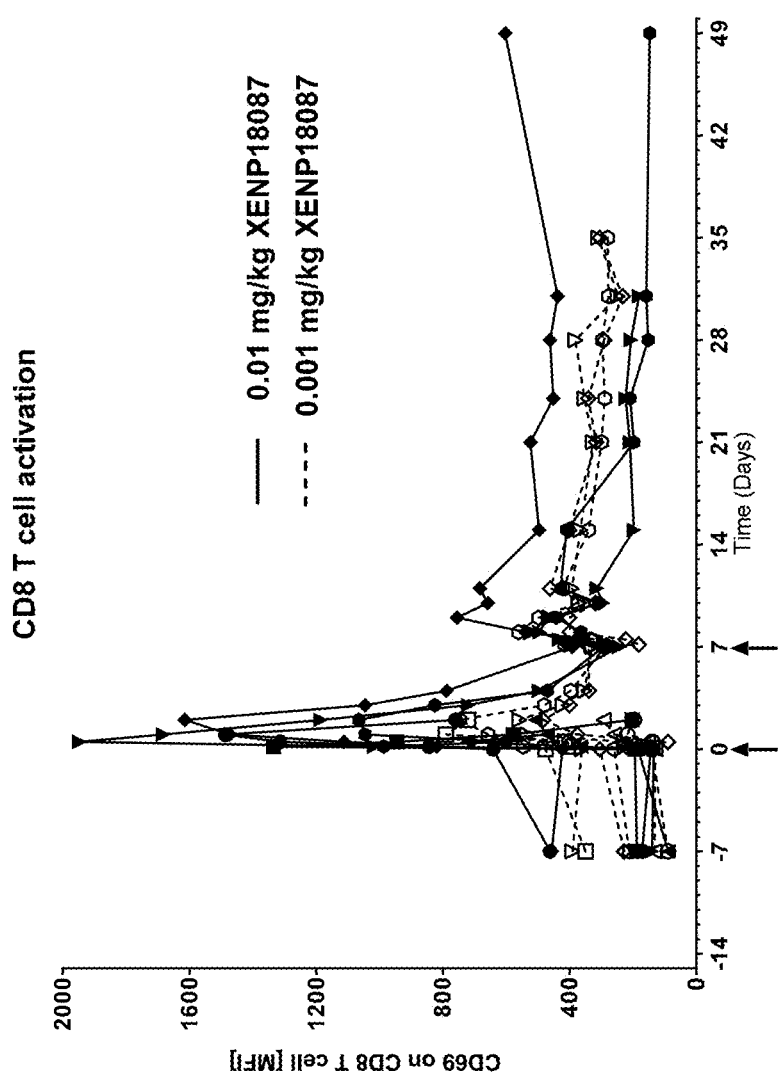
Figure 22D:
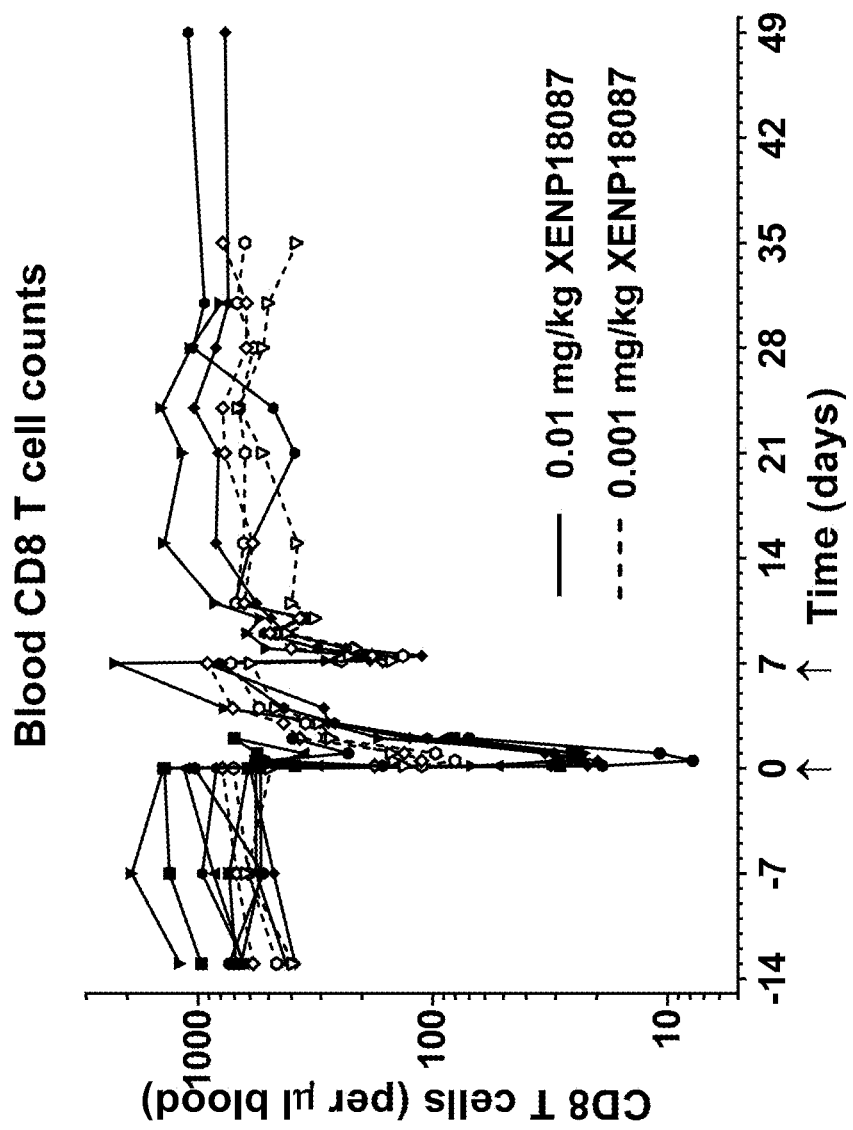
Figure 22E:
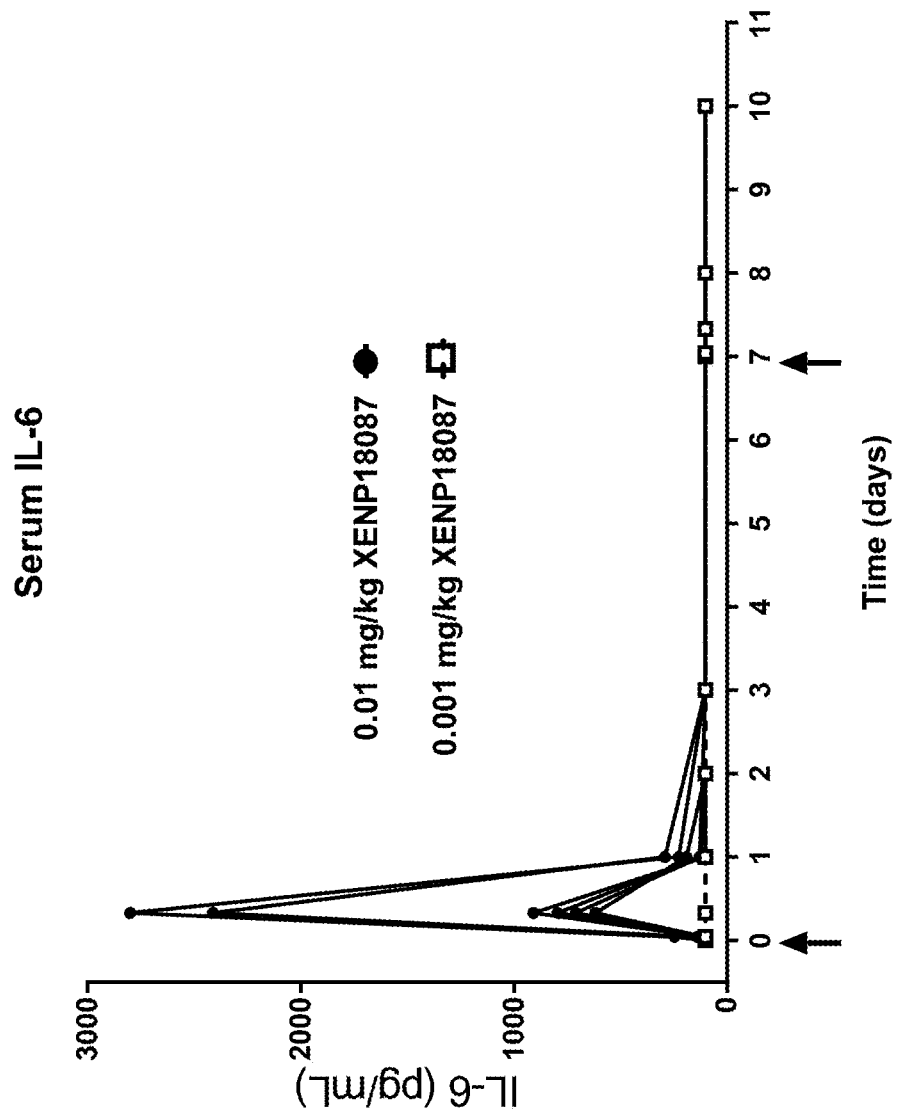
Figure 22F:
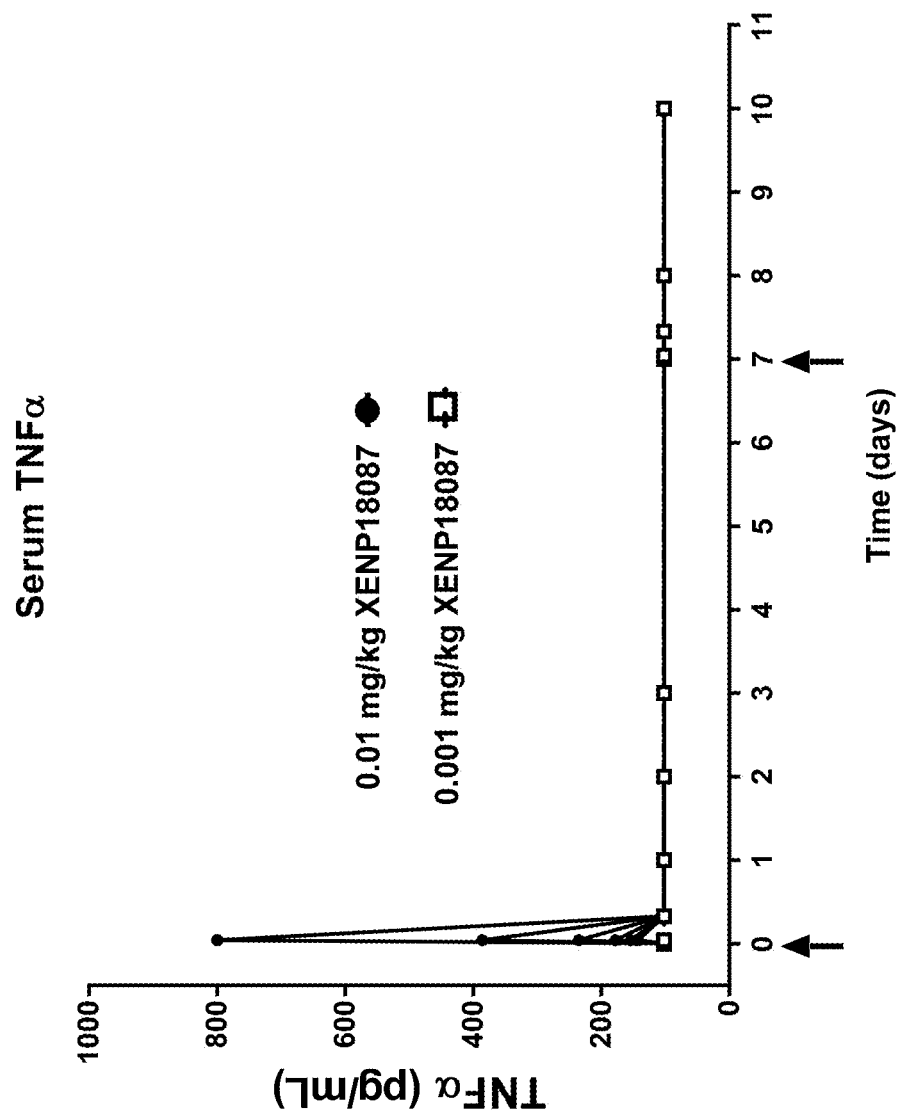

FIGS. 22A-22F depict additional studies of an exemplary anti-SSTR2×anti-CD3 bispecific antibody on CD4$^+$ and CD8$^+$ T cell activation (FIGS. 22A and B), CD4$^+$ and CD8$^+$ T cell distribution (FIGS. 22C and D) and serum levels of serum IL-6 and TNFα (FIGS. 22E and F).

FIGS. 23A-23C depict cell surface binding assays of XmAb18087 and XENP13245 on human SSTR2-transfected CHO cells (FIG. 22A), cyno SSTR2-transfected CHO cells (FIG. 22B), and untransfected parental CHO cells (FIG. 22C).

Figure 24B:
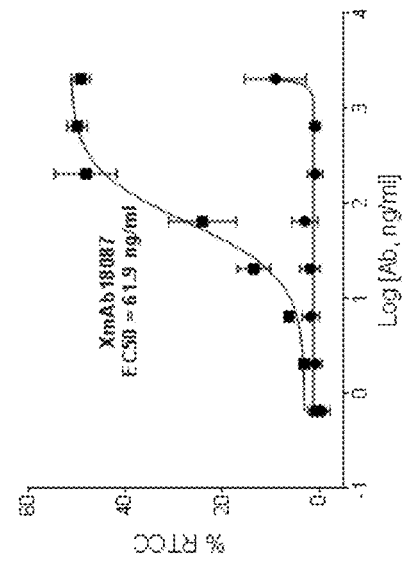
Figure 24A:
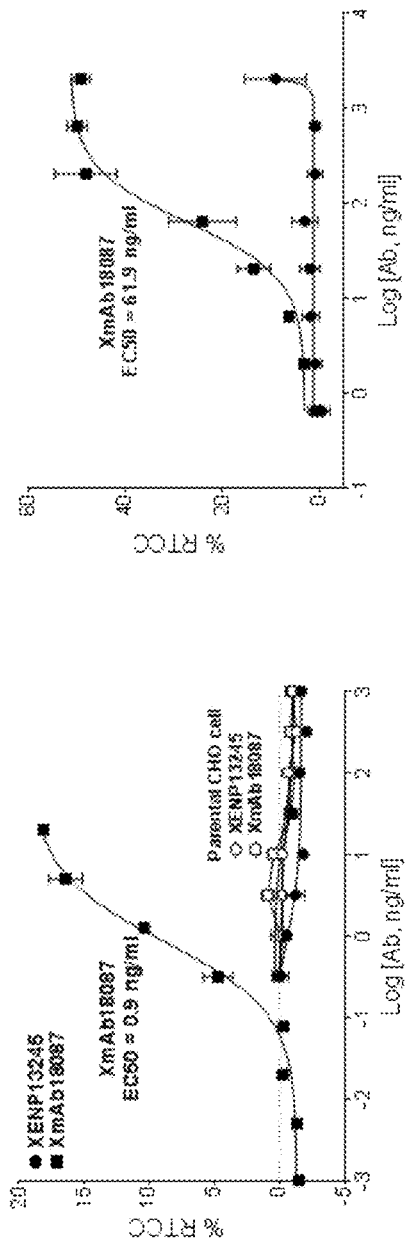
Figure 24C:
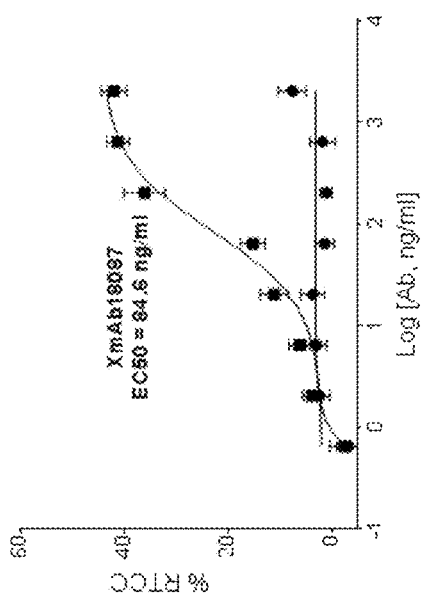

FIGS. 24A-24C depict the results of a redirected T cell cytotoxicity (RTCC) assay, using XmAb18087 (squares) and XENP13245 (circles) with human SSTR2-transfected CHO cells (FIG. 24A), TT cells (human thyroid medullary carcinoma cell line, FIG. 28B) or A548 cells (lung adenocarcinoma cell line, FIG. 24C).

Figure 25:
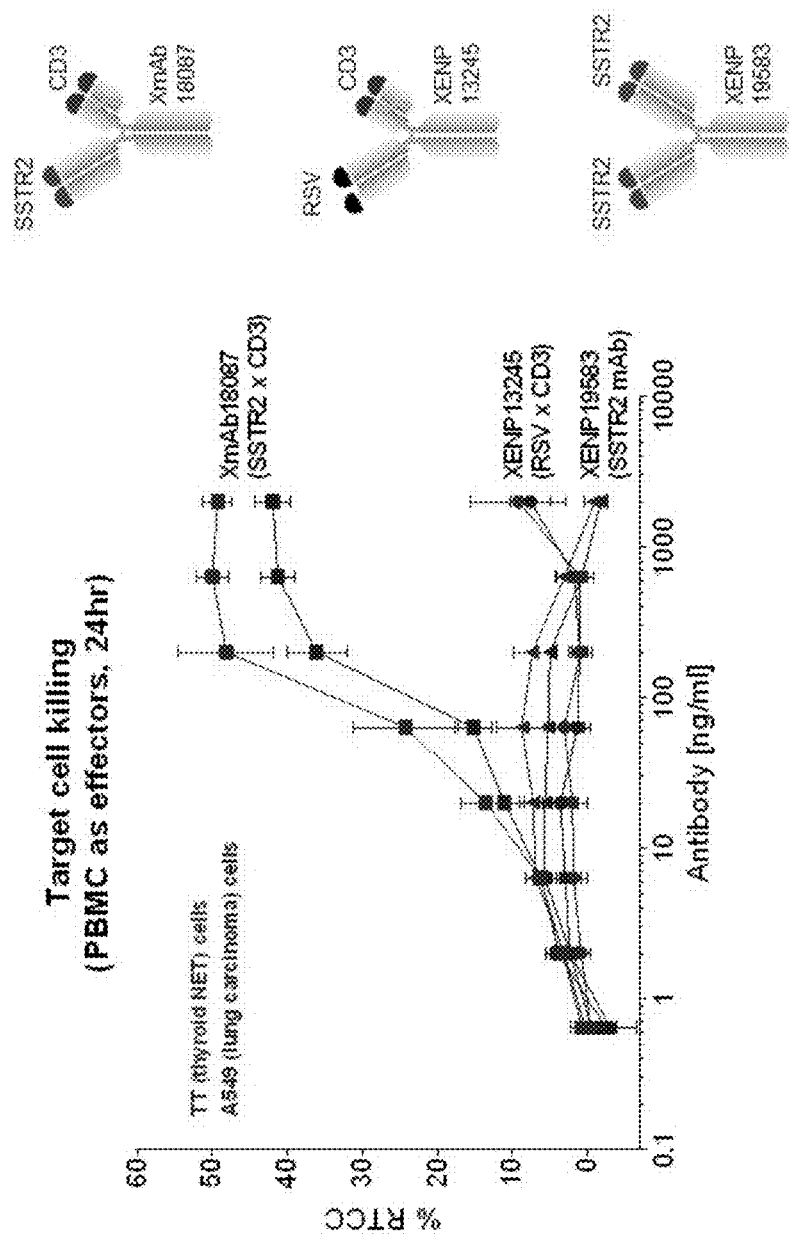

FIG. 25 depicts three results of a redirected T cell cytotoxicity (RTCC) assay, using anti-SSTR2×anti-CD3 bispecific and controls anti-SSTR2 mAb and anti-RSV×anti-CD3 with TT cells (human thyroid medullary carcinoma cell line) or A548 cells (lung carcinoma).

Figure 26A:
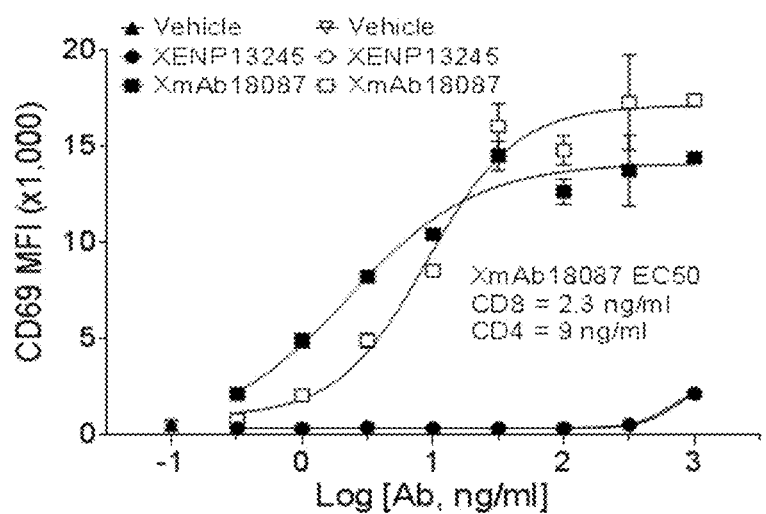
Figure 26B:
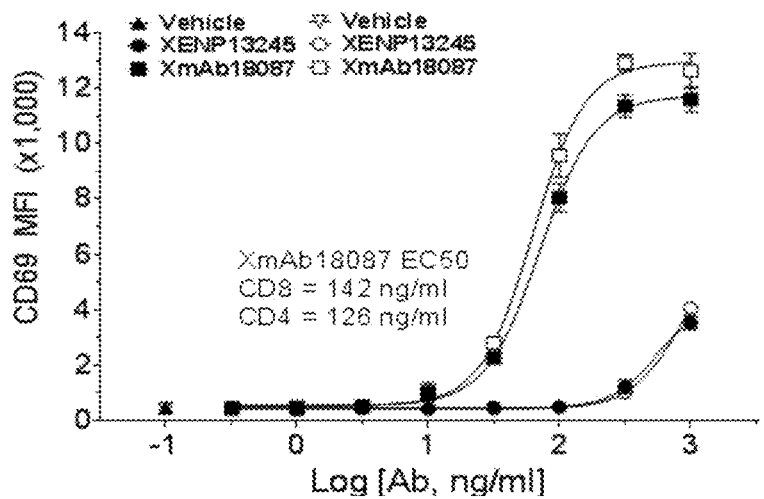

FIGS. 26A-26B depicts upregulation of CD69 on CD4$^+$ and CD8$^+$ T cells incubated with human SSTR2 transfected CHO cells (FIG. 29A) and TT cells (FIG. 29B) after 24 h for the experiment described in FIG. 2. Filled data points show CD69 MFI on CD8$^+$ T cells and empty data points show CD69 MFI on CD4$^+$ T cells.

Figure 27:
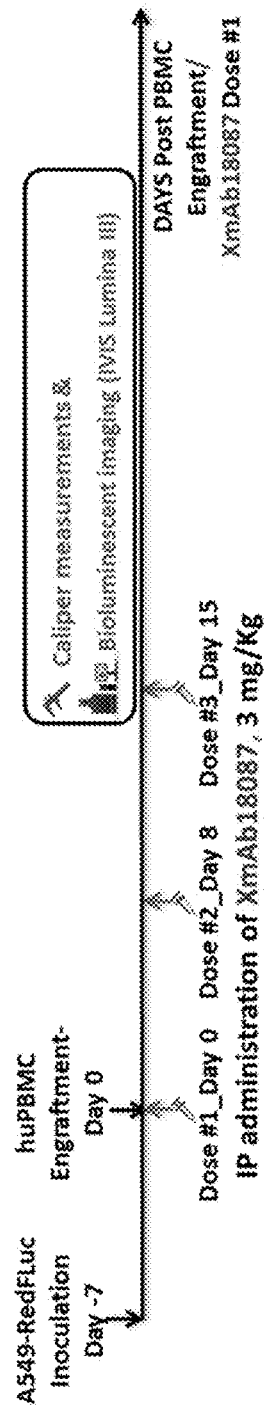

FIG. 27 depicts the design of mouse study to examine anti-tumor activity of XmAb18087.

Figure 28A:
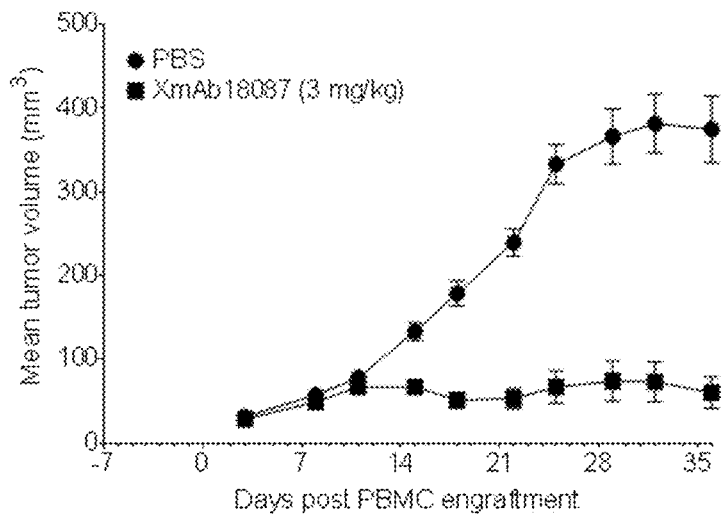
Figure 28B:
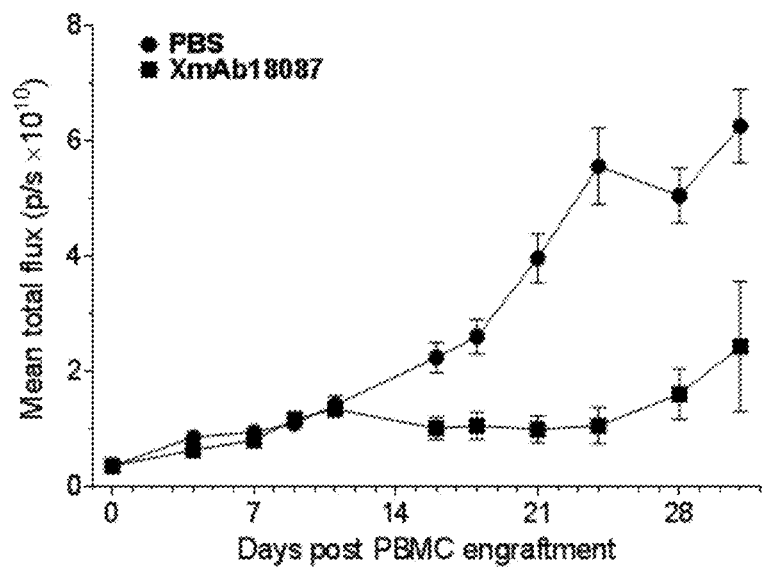

FIG. 28A-28B depicts tumor size measured by IVIS® as a function of time and treatment.

FIG. 29 depicts IVIS® bioluminescent images (Day 28 post dose #1).

Figure 30A:
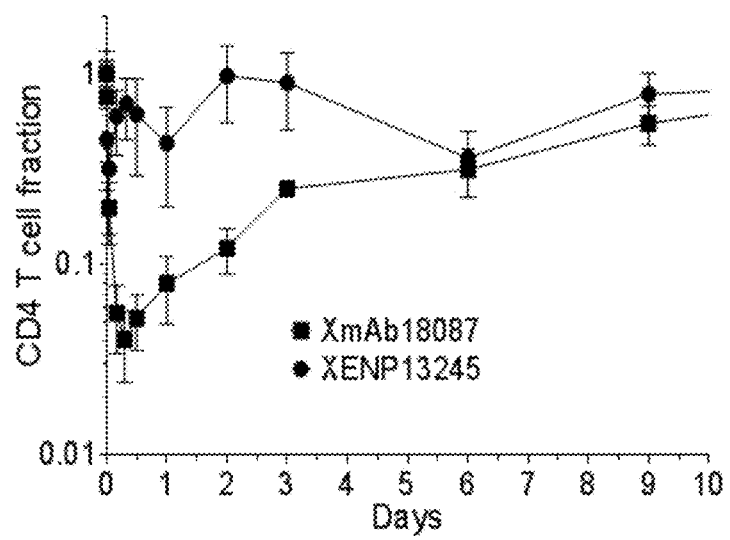
Figure 30B:
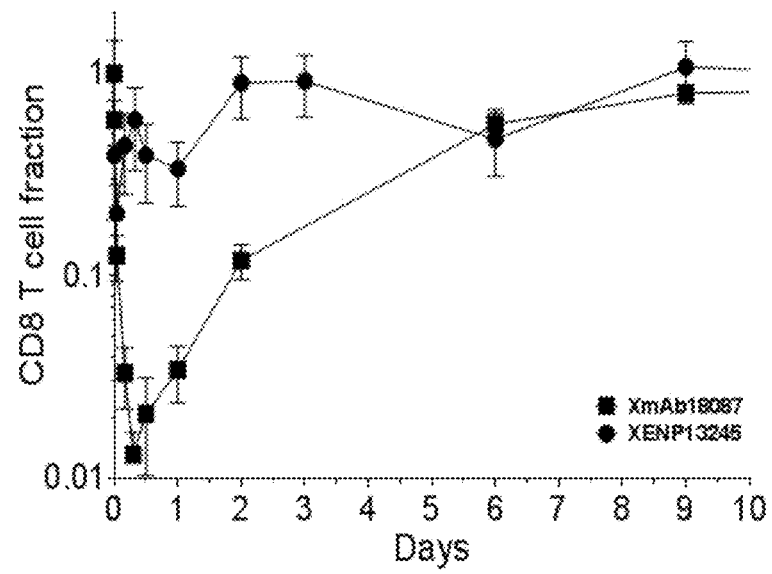

FIGS. 30A-30B depict a study of the effects of XmAb18087 on CD4$^+$ (FIG. 30A) and CD8$^+$ (FIG. 30B) T cell distribution in cynomolgus monkeys.

Figure 31A:
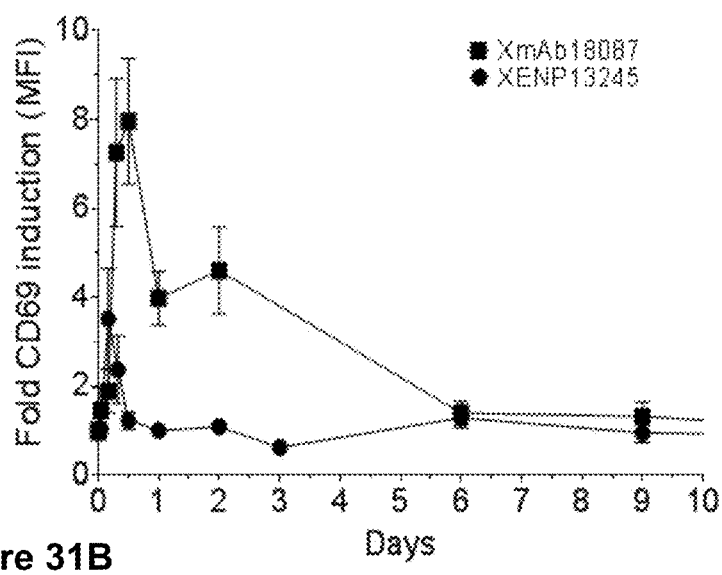
Figure 31B:
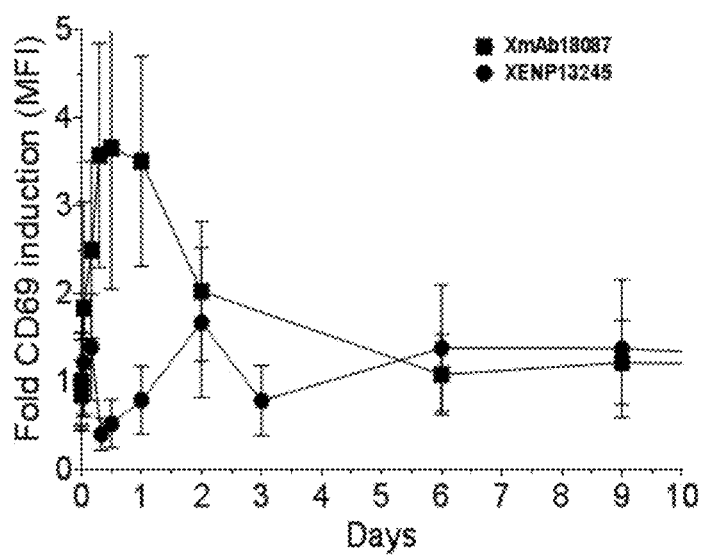

FIGS. 31A-31B depict a study of the effects of XmAb18087 on CD4$^+$ (FIG. 31A) and CD8$^+$ (FIG. 31B) T cell activation in cynomolgus monkeys.

FIGS. 32A-32B depicts the effect of XmAb18087 on the level of serum IL-6 and TNF in cynomolgus monkeys.

Figure 33:
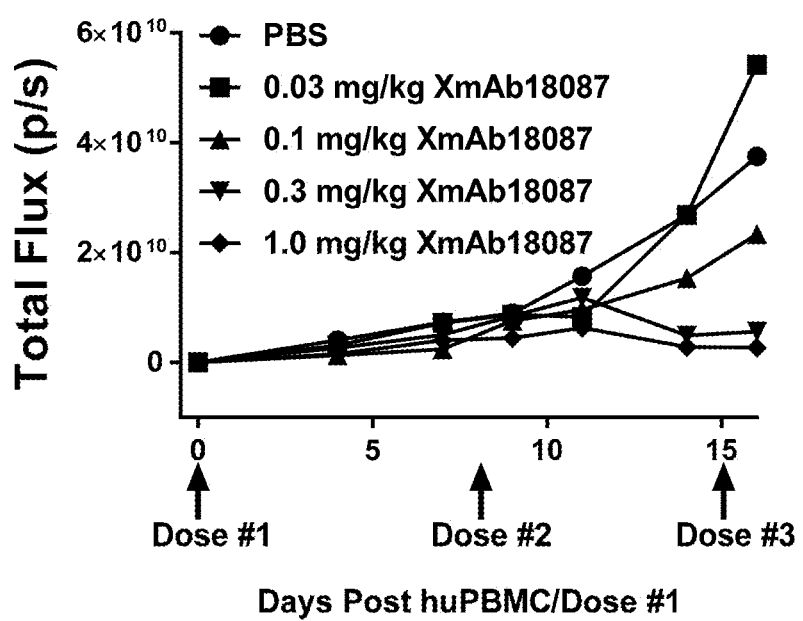

FIG. 33 depict tumor size in NSG mice engrafted with A549-RedFLuc tumor cells and human PBMCs as measured by IVIS® as a function of time and treatment using various concentrations of XmAb18087.

DETAILED DESCRIPTION OF THE INVENTION

A. Incorporation of Materials
Figures and Legends

All the figures and accompanying legends of U.S. Ser. Nos. 62/481,065, 62/397,322, 62/355,821 and 62/355,820 are expressly and independently incorporated by reference herein in their entirety, particularly for the amino acid sequences depicted therein.

Sequences

Reference is made to the accompanying sequence listing as follows. Anti-SSTR2 sequences suitable for use as ABDs include SEQ ID NOs: 958-1069 (FIG. 11) and the variable heavy domain, the variable light domain, and CDRs of the anti-SSTR2 heavy chain and light chain sequences of SEQ ID NOs: 58 to 659. Anti-CD3 sequences suitable for use as ABDs include the variable heavy domain, the variable light domain, and CDRs included in SEQ ID NOs: 1-54 (FIG. 12) and SEQ ID NOs: 835 to 938. The variable heavy domain, the variable light domain, and CDRs can be included in scFv or Fv formats of the subject antibodies and antigen binding domains described herein.

Sequences of exemplary bispecific SSTR2×CD3 antibodies are included in SEQ ID NO: 1070 to 1088 (FIG. 14); and SEQ ID NOs: 1089 to 1107 and 660 to 806 (FIG. 15).

B. Overview

Provided herein are anti-SSTR2 antibodies that are useful for the treatment of cancers. As SSTR2 is high expressed in neuroendocrine tumors (NETs, e.g., lung, GI, pancreatic, pituitary, medullary cancers, prostate, pancreatic lungcarcinoids, osteosarcoma, etc.) as well as non-NETs (breast, lung, colarectal, ovarian, cervial cancers, etc.), it is believed that anti-SSTR2 antibodies are useful for localizing anti-tumor therapeutics (e.g., chemotherapeutic agents and T cells) to such SSTR2 expressing tumors. In particular, provided herein are anti-CD3, anti-SSTR2 bispecific antibodies. Such antibodies are used to direct CD3+ effector T cells to SSTR2+ tumors, thereby allowing the CD3+ effector T cells to attack and lyse the SSTR2+ tumors.

Anti-bispecific antibodies that co-engage CD3 and a tumor antigen target have been designed and used to redirect T cells to attack and lyse targeted tumor cells. Examples include the BiTE and DART formats, which monovalently engage CD3 and a tumor antigen. While the CD3-targeting approach has shown considerable promise, a common side effect of such therapies is the associated production of cytokines, often leading to toxic cytokine release syndrome. Because the anti-CD3 binding domain of the bispecific antibody engages all T cells, the high cytokine-producing CD4 T cell subset is recruited. Moreover, the CD4 T cell subset includes regulatory T cells, whose recruitment and expansion can potentially lead to immune suppression and have a negative impact on long-term tumor suppression. In addition, these formats do not contain Fc domains and show very short serum half-lives in patients.

While the CD3-targeting approach has shown considerable promise, a common side effect of such therapies is the associated production of cytokines, often leading to toxic cytokine release syndrome. Because the anti-CD3 binding domain of the bispecific antibody engages all T cells, the high cytokine-producing CD4 T cell subset is recruited. Moreover, the CD4 T cell subset includes regulatory T cells, whose recruitment and expansion can potentially lead to immune suppression and have a negative impact on long-term tumor suppression. One such possible way to reduce cytokine production and possibly reduce the activation of CD4 T cells is by reducing the affinity of the anti-CD3 domain for CD3.

Accordingly, in some embodiments the present invention provides antibody constructs comprising anti-CD3 antigen binding domains that are "strong" or "high affinity" binders to CD3 (e.g. one example are heavy and light variable domains depicted as H1.30_L1.47 (optionally including a charged linker as appropriate)) and also bind to SSTR2. In other embodiments, the present invention provides antibody constructs comprising anti-CD3 antigen binding domains that are "lite" or "lower affinity" binders to CD3. Additional embodiments provides antibody constructs comprising anti-CD3 antigen binding domains that have intermediate or "medium" affinity to CD3 that also bind to CD38. Affinity is generally measured using a Biacore assay.

It should be appreciated that the "high, medium, low" anti-CD3 sequences of the present invention can be used in a variety of heterodimerization formats. While the majority of the disclosure herein uses the "bottle opener" format of heterodimers, these variable heavy and light sequences, as well as the scFv sequences (and Fab sequences comprising these variable heavy and light sequences) can be used in other formats, such as those depicted in FIG. 2 of WO Publication No. 2014/145806, the Figures, formats and legend of which is expressly incorporated herein by reference.

Accordingly, in one aspect, provided herein are heterodimeric antibodies that bind to two different antigens, e.g the antibodies are "bispecific", in that they bind two different target antigens, generally SSTR2 as described below. These heterodimeric antibodies can bind these target antigens either monovalently (e.g. there is a single antigen binding domain such as a variable heavy and variable light domain pair) or bivalently (there are two antigen binding domains that each independently bind the antigen). The heterodimeric antibodies provided herein are based on the use different monomers which contain amino acid substitutions that "skew" formation of heterodimers over homodimers, as is more fully outlined below, coupled with "pI variants" that allow simple purification of the heterodimers away from the homodimers, as is similarly outlined below. The heterodimeric bispecific antibodies provided generally rely on the use of engineered or variant Fc domains that can self-assemble in production cells to produce heterodimeric proteins, and methods to generate and purify such heterodimeric proteins.

C. Nomenclature

The bispecific antibodies of the invention are listed in several different formats. Each polypeptide is given a unique "XENP" number, although as will be appreciated in the art, a longer sequence might contain a shorter one. For example, the heavy chain of the scFv side monomer of a bottle opener format for a given sequence will have a first XENP number, while the scFv domain will have a different XENP number. Some molecules have three polypeptides, so the XENP number, with the components, is used as a name. Thus, the molecule XENP18087, which is in bottle opener format, comprises three sequences: "XENP18087 HC-Fab" (FIG. 14A, termed "SSTR2 Fab-Fc Heavy Chain), "XENP18087 HC-scFv" (FIG. 14B, termed "CD3 scFv-Fc Heavy Chain") and "XENP18087 LC" (FIG. 14A, termed "SSTR2 Light Chain") or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the scFv-Fc domain has a full length sequence, an scFv sequence, a variable light sequence, 3 light CDRs, a scFv linker, a variable heavy sequence and 3 heavy CDRs; note that all molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of the Fab side of XENP18087 is "H1.143 L1.30", which indicates that the variable heavy domain, H1.143, was combined with the light domain L1.30. In the case that these sequences are used as scFvs, the designation "H1.143_L1.30", indicates that the variable heavy domain, H1.143, was combined with the light domain, L1.30, and is in vh-linker-vl orientation, from N- to C-terminus. This molecule with the identical sequences of the heavy and light variable domains but in the reverse order would be named "L1.30_H1.143". Similarly, different constructs may "mix and match" the heavy and light chains as will be evident from the sequence listing and the Figures.

D. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore, SPR or BLI assay. Of particular use in the ablation of FcγR binding are those shown in FIG. 5, which generally are added to both monomers.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "checkpoint antigen binding domain" binds a target checkpoint antigen as outlined herein. As is known in the art, these CDRs are generally present as a first set of variable heavy CDRs (vhCDRs or VHCDRs) and a second set of variable light CDRs (vlCDRs or VLCDRs), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. (See Table 1 and related discussion above for CDR numbering schemes). Thus, in some cases, the six CDRs of the antigen binding domain are contributed by a variable heavy and a variable light domain. In a "Fab" format, the set of 6 CDRs are contributed by two different polypeptide sequences, the variable heavy domain (vh or VH; containing the vhCDR1, vhCDR2 and vhCDR3) and the variable light domain (vl or VL; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or vl-linker-vh, with the former being generally preferred (including optional domain linkers on each side, depending on the format used (e.g. from FIG. 1). In general, the C-terminus of the scFv domain is attached to the N-terminus of the hinge in the second monomer.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAsp-Glu after position 233 and before position 234.

By "amino acid deletion" or "deletion" as used herein is meant the removal of an amino acid sequence at a particular position in a parent polypeptide sequence. For example, E233- or E233#, E233( ) or E233del designates a deletion of glutamic acid at position 233. Additionally, EDA233- or EDA233# designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST.

As described below, in some embodiments the parent polypeptide, for example an Fc parent polypeptide, is a human wild type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, N434S/M428L is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference). See also Edelman et al., 1969, Proc Natl Acad Sci USA 63:78-85, hereby entirely incorporated by reference. The modification can be an addition, deletion, or substitution.

By "protein" herein is meant at least two covalently attached amino acids, which includes proteins, polypeptides, oligopeptides and peptides. In addition, polypeptides that make up the antibodies of the invention may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains, generally on two different polypeptide chains (e.g. VH-CH1 on one chain and VL-CL on the other). Fab may refer to this region in isolation, or this region in the context of a bispecific antibody of the invention. In the context of a Fab, the Fab comprises an Fv region in addition to the CH1 and CL domains.

By "Fv" or "Fv fragment" or "Fv region" as used herein is meant a polypeptide that comprises the VL and VH domains of an ABD. Fv regions can be formatted as both Fabs (as discussed above, generally two different polypeptides that also include the constant regions as outlined above) and scFvs, where the vl and vh domains are combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh). In the sequences depicted in the sequence listing and in the figures, the order of the vh and vl domain is indicated in the name, e.g. H.X_L.Y means N- to C-terminal is vh-linker-vl, and L.Y_H.X is vl-linker-vh.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is one that increases binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "Fc" or "Fc region" or "Fc domain" as used herein is meant the polypeptide comprising the CH2-CH3 domains of an IgG molecule, and in some cases, inclusive of the hinge. In EU numbering for human IgG1, the CH2-CH3 domain comprises amino acids 231 to 447, and the hinge is 216 to 230. Thus the definition of "Fc domain" includes both amino acids 231-447 (CH2-CH3) or 216-447 (hinge-CH2-CH3), or fragments thereof. An "Fc fragment" in this context may contain fewer amino acids from either or both of the N- and C-termini but still retains the ability to form a dimer with another Fc domain or Fc fragment as can be detected using standard methods, generally based on size (e.g. non-denaturing chromatography, size exclusion chromatography, etc.) Human IgG Fc domains are of particular use in the present invention, and can be the Fc domain from human IgG1, IgG2 or IgG4.

A "variant Fc domain" contains amino acid modifications as compared to a parental Fc domain. Thus, a "variant human IgG1 Fc domain" is one that contains amino acid modifications (generally amino acid substitutions, although in the case of ablation variants, amino acid deletions are included) as compared to the human IgG1 Fc domain. In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Alternatively, the variant Fc domains can have up to 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains herein still retain the ability to form a dimer with another Fc domain as measured using known techniques as described herein, such as non-denaturing gel electrophoresis.

By "heavy chain constant region" herein is meant the CH1-hinge-CH2-CH3 portion of an antibody (or fragments thereof), excluding the variable heavy domain; in EU numbering of human IgG1 this is amino acids 118-447 By "heavy chain constant region fragment" herein is meant a heavy chain constant region that contains fewer amino acids from either or both of the N- and C-termini but still retains the ability to form a dimer with another heavy chain constant region.

By "position" as used herein is meant a location in the sequence of a protein. Positions may be numbered sequentially, or according to an established format, for example the EU index for antibody numbering.

By "target antigen" as used herein is meant the molecule that is bound specifically by the antigen binding domain comprising the variable regions of a given antibody. As discussed below, in the present case the target antigens are checkpoint inhibitor proteins.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the invention herein is meant a cell that contains the exogeneous nucleic acids encoding the components of the bispecific antibody and is capable of expressing the bispecific antibody under suitable conditions. Suitable host cells are discussed below.

By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (vhCDR1, vhCDR2 and vhCDR3 for the variable heavy domain and vlCDR1, vlCDR2 and vlCDR3 for the variable light domain) and four framework (FR) regions, arranged from amino-terminus to carboxy-terminus in the following order: FR1-CDR1-FR2-CDR2-FR3-CDR3-FR4.

By "wild type or WT" herein is meant an amino acid sequence or a nucleotide sequence that is found in nature, including allelic variations. A WT protein has an amino acid sequence or a nucleotide sequence that has not been intentionally modified.

The invention provides a number of antibody domains that have sequence identity to human antibody domains.

Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, C D. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see https://blast.ncbi.nlm.nih.gov/Blast.cgi. When using any of the aforementioned algorithms, the default parameters (for Window length, gap penalty, etc) are used. In one embodiment, sequence identity is done using the BLAST algorithm, using default parameters The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogeneous host cells, and they can be isolated as well.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore, SPR or BLI assay.

E. Antibodies

In one aspect, provided herein are compositions that bind to SSTR2 (e.g., anti-SSTR2 antibodies). In certain embodiments, the antibody binds to human SSTR2 (FIG. 11). Subject anti-SSTR2 antibodies include monospecific SSTR2 antibodies, as well as multi-specific (e.g., bispecific) anti-SSTR2 antibodies. In certain embodiments, the anti-SSTR2 antibody has a format according to any one of the antibody formats depicted in FIG. 1.

In some embodiments, the subject compositions include an SSTR2 binding domain. In some embodiments, the composition includes an antibody having an SSTR2 binding domain. Antibodies provided herein include one, two, three, four, and five or more SSTR2 binding domains. In certain embodiments, the SSTR2 binding domain includes the vhCDR1, vhCDR2, vhCDR3, vlCDR1, vlCDR2 and vlCDR3 sequences of an SSTR2 binding domain selected from the group consisting of those depicted in FIG. 11. In some embodiments, the SSTR2 binding domain includes the underlined vhCDR1, vhCDR2, vhCDR3, vlCDR1, vlCDR2 and vlCDR3 sequences of an SSTR2 binding domain selected from those depicted in FIG. 11. In some embodiments, the SSTR2 binding domain includes the variable heavy domain and variable light domain of an SSTR2 binding domain selected from those depicted in FIG. 11. SSTR2 binding domains depicted in FIG. 11 include anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; anti-SSTR2 H1.125_L1.108; anti-SSTR2 H1.125_L1.111; anti-SSTR2 H1.125_L1.114; Anti-SSTR2 H1.125_L1.102; and anti-SSTR2 H1.125_L1.10. In an exemplary embodiment, the antibody includes an anti-SSTR2 H1.143_L1.30 binding domain.

In some embodiments, the antibody is a bispecific antibody that binds SSTR2 and CD3. Such antibodies include a CD3 binding domain and at least one SSTR2 binding domain. Any suitable SSTR2 binding domain can be included in the anti-SSTR2X anti-CD3 bispecific antibody. In some embodiments, the anti-SSTR2X anti-CD3 bispecific antibody includes one, two, three, four or more SSTR2 binding domains, including but not limited to those depicted in FIG. 11. In certain embodiments, the anti-SSTR2X anti-CD3 antibody includes a SSTR2 binding domain that includes the vhCDR1, vhCDR2, vhCDR3, vlCDR1, vlCDR2 and vlCDR3 sequences of an SSTR2 binding domain selected from the group consisting of those depicted in Figures FIG. 11. In some embodiments, the anti-SSTR2X anti-CD3 antibody includes a SSTR2 binding domain that includes the underlined vhCDR1, vhCDR2, vhCDR3, vlCDR1, vlCDR2 and vlCDR3 sequences of an SSTR2 binding domain selected from the group consisting of those depicted in FIG. 11. In some embodiments, the anti-SSTR2X anti-CD3 antibody includes a SSTR2 binding domain that includes the variable heavy domain and variable light domain of an SSTR2 binding domain selected from the group consisting of those depicted in FIG. 11. In an exemplary embodiment, the anti-SSTR2X anti-CD3 antibody includes an anti-SSTR2 H1.143_L1.30 binding domain.

The anti-SSTR2×anti-CD3 antibody provided herein can include any suitable CD3 binding domain. In certain embodiments, the anti-SSTR2X anti-CD3 antibody includes a CD3 binding domain that includes the vhCDR1, vhCDR2, vhCDR3, vlCDR1, vlCDR2 and vlCDR3 sequences of a CD3 binding domain selected from the group consisting of those depicted in FIGS. 12 and 13. In some embodiments, the anti-SSTR2X anti-CD3 antibody includes a CD3 binding domain that includes the underlined vhCDR1, vhCDR2, vhCDR3, vlCDR1, vlCDR2 and vlCDR3 sequences of a CD3 binding domain selected from the group consisting of those depicted in FIG. 12 or 13. In some embodiments, the anti-SSTR2X anti-CD3 antibody includes a CD3 binding domain that includes the variable heavy domain and variable light domain of a CD3 binding domain selected from the group consisting of those depicted in FIG. 12 or 13. In some embodiments, the CD3 binding domain is selected from anti-CD3 H1.30_L1.47, anti-CD3 H1.32_L1.47; anti-CD3 H1.89$_{13}$ L1.48; anti-CD3 H1.90$_{13}$ L1.47; Anti-CD3 H1.33$_{13}$ L1.47; and anti-CD3 H1.31$_{13}$ L1.47.

As used herein, term "antibody" is used generally. Antibodies that find use in the present invention can take on a number of formats as described herein, including traditional antibodies as well as antibody derivatives, fragments and mimetics, described herein.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several subclasses, including, but not limited to IgG1, IgG2, IgG3, and IgG4. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the antibodies herein have at least one the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention includes the use of human IgG1/G2 hybrids.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vlCDRs (e.g. vlCDR1, vlCDR2 and vlCDR3). A useful comparison of CDR numbering is as below, see Lafranc et al., *Dev. Comp. Immunol.* 27(1):55-77 (2003):

TABLE 1

|  | Kabat + Chothia | IMGT | Kabat | AbM | Chothia | Contact | Xencor |
| --- | --- | --- | --- | --- | --- | --- | --- |
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

Another type of Ig domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (p230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined below, is the Fc region.

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the —CH2-CH3 domain, and optionally a hinge domain (—H—CH2-CH3). In the embodiments herein, when a scFv is attached to an Fc domain, it is the C-terminus of the scFv construct that is attached to all or part of the hinge of the Fc domain; for example, it is generally attached to the sequence EPKS which is the beginning of the hinge. The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, the C-terminus of the variable heavy chain is attached to the N-terminus of the scFv linker, the C-terminus of which is attached to the N-terminus of a variable light chain (N-vh-linker-vl-C) although that can be switched (N-vl-linker-vh-C).

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIG. 1).

As shown herein, there are a number of suitable linkers (for use as either domain linkers or scFv linkers) that can be used to covalently attach the recited domains, including traditional peptide bonds, generated by recombinant techniques. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n, (GGGGS)n, and (GGGS)n, where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. For example, in FIG. 1F, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n, (GGGGS)n, and (GGGS)n, where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the linker is a scFv linker, used to covalently attach the vh and vl domains as discussed herein. In many cases, the scFv linker is a charged scFv linker, a number of which are shown in FIG. 7. Accordingly, the present invention further provides charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 7 can be used in any embodiment herein where a linker is utilized.

In particular, the formats depicted in FIG. 1 are antibodies, usually referred to as "heterodimeric antibodies", meaning that the protein has at least two associated Fc sequences self-assembled into a heterodimeric Fc domain and at least two Fv regions, whether as Fabs or as scFvs.

F. Chimeric and Humanized Antibodies

In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

G. Heterodimeric Antibodies

Accordingly, in some embodiments, the subject antibody is a heterodimeric antibody that relies on the use of two different heavy chain variant Fc sequences. Such an antibody will self-assemble to form a heterodimeric Fc domain and heterodimeric antibody.

The present invention is directed to novel constructs to provide heterodimeric antibodies that allow binding to more than one antigen or ligand, e.g. to allow for bispecific binding (e.g., anti-SSTR2 and anti-CD3 binding). The heterodimeric antibody constructs are based on the self-assembling nature of the two Fc domains of the heavy chains of antibodies, e.g. two "monomers" that assemble into a "dimer". Heterodimeric antibodies are made by altering the amino acid sequence of each monomer as more fully discussed below. Thus, the present invention is generally directed to the creation of heterodimeric antibodies which can co-engage antigens (e.g., SSTR2 and CD3) in several ways, relying on amino acid variants in the constant regions that are different on each chain to promote heterodimeric formation and/or allow for ease of purification of heterodimers over the homodimers.

Thus, the present invention provides bispecific antibodies. In some embodiments, the present invention provides bispecific antibodies that include an SSTR2 binding domain. In some embodiments, the bispecific antibody is an anti-SSTR2×anti-CD3 bispecific antibody. An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in purifying the heterodimeric antibodies away from the homodimeric antibodies and/or biasing the formation of the heterodimer over the formation of the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, which encourage heterodimerization formation over homodimerization formation, coupled with pI variants, which increase the pI difference between the two monomers to facilitate purification of heterodimers away from homodimers.

Additionally, as more fully outlined below, depending on the format of the heterodimer antibody, pI variants can be either contained within the constant and/or Fc domains of a monomer, or charged linkers, either domain linkers or scFv linkers, can be used. That is, scaffolds that utilize scFv(s) such as the Triple F, or "bottle opener", format can include charged scFv linkers (either positive or negative), that give a further pI boost for purification purposes. As will be appreciated by those in the art, some Triple F formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (aspartic acid to lysine) or changing a charged residue to a neutral residue (e.g. loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease it's pI (wt A−+B or wt A−−B), or by increasing one region and decreasing the other region (A+−B− or A−B+).

Thus, in general, a component of some embodiments of the present invention are amino acid variants in the constant regions of antibodies that are directed to altering the isoelectric point (pI) of at least one, if not both, of the monomers of a dimeric protein to form "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the triple F format, the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in FIG. 1, for example, several of the formats allow separation of heterodimers and homodimers on the basis of size.

In the case where pI variants are used to achieve heterodimerization, by using the constant region(s) of the heavy chain(s), a more modular approach to designing and purifying bispecific proteins, including antibodies, is provided. Thus, in some embodiments, heterodimerization variants (including skew and purification heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of bispecific antibodies, as the ability to either eliminate, minimize and distinguish when homodimers are present is significant. Similarly, the ability to reliably test the reproducibility of the heterodimeric antibody production is important.

Heterodimerization Variants

The present invention provides heterodimeric proteins, including heterodimeric antibodies in a variety of formats, which utilize heterodimeric variants to allow for heterodimeric formation and/or purification away from homodimers.

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in FIG. 12.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 3, with FIG. 8 showing some pairs of particular utility in many embodiments. Of particular use in many embodiments are the pairs of sets including, but not limited to, S364K/E357Q: L368D/K370S; L368D/K370S:S364K; L368E/K370S: S364K; T411T/E360E/Q362E:D401K; L368D/K370S: S364K/E357L and K370S:S364K/E357Q. In terms of nomenclature, the pair "S364K/E357Q:L368D/K370S" means that one of the monomers has the double variant set S364K/E357Q and the other has the double variant set L368D/K370S.

pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 4. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, for example in the FIGS. 1A, E, F, G, H and I formats, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)$_4$ (SEQ ID NO: 818). However, as will be appreciated by those in the art, the first monomer includes a CH1 domain, including position 208. Accordingly, in constructs that do not include a CH1 domain (for example for antibodies that do not utilize a CH1 domain on one of the domains, for example in a dual scFv format or a "one armed" format such as those depicted in FIG. 1B, C or D), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 4 and the other monomer has a charged linker (either in the form of a charged scFv linker because that monomer comprises an scFv or a charged domain linker, as the format dictates, which can be selected from those depicted in FIG. 7).

Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), U.S. Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, there are additional Fc substitutions that find use in increased binding to the FcRn receptor and increased serum half life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259/308F/428L.

Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific antibodies that bind CD3 monovalently it is generally desirable to ablate FcγRIIIa binding to eliminate or significantly reduce ADCC activity. wherein one of the Fc domains comprises one or more Fcγ receptor ablation variants. These ablation variants are depicted in FIG. 14, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

As is known in the art, the Fc domain of human IgG1 has the highest binding to the Fcγ receptors, and thus ablation variants can be used when the constant domain (or Fc domain) in the backbone of the heterodimeric antibody is IgG1. Alternatively, or in addition to ablation variants in an IgG1 background, mutations at the glycosylation position 297 (generally to A or S) can significantly ablate binding to FcγRIIIa, for example. Human IgG2 and IgG4 have naturally reduced binding to the Fcγ receptors, and thus those backbones can be used with or without the ablation variants.

Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

H. Useful Formats of the Invention

As will be appreciated by those in the art and discussed more fully below, the heterodimeric fusion proteins of the present invention can take on a wide variety of configurations, as are generally depicted in FIG. 1. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, the present invention is directed to novel immunoglobulin compositions that co-engage a different first and a second antigen.

As will be appreciated by those in the art, the heterodimeric formats of the invention can have different valencies as well as be bispecific. That is, heterodimeric antibodies of the invention can be bivalent and bispecific, wherein one target tumor antigen (e.g. CD3) is bound by one binding domain and the other target tumor antigen (e.g. SSTR2) is bound by a second binding domain. The heterodimeric antibodies can also be trivalent and bispecific, wherein the first antigen is bound by two binding domains and the second antigen by a second binding domain. As is outlined herein, when CD3 is one of the target antigens, it is preferable that the CD3 is bound only monovalently, to reduce potential side effects.

The present invention utilizes anti-CD3 antigen binding domains in combination with anti-SSTR2 binding domains. As will be appreciated by those in the art, any collection of anti-CD3 CDRs, anti-CD3 variable light and variable heavy domains, Fabs and scFvs as depicted in any of the Figures (see particularly FIGS. 2 through 7, and FIG. 18) can be used. Similarly, any of the anti-SSTR2 antigen binding domains can be used, whether CDRs, variable light and variable heavy domains, Fabs and scFvs as depicted in any of the Figures (e.g., FIGS. 8 and 10) can be used, optionally and independently combined in any combination.

Bottle Opener

One heterodimeric scaffold that finds particular use in the present invention is the "triple F" or "bottle opener" scaffold format as shown in FIG. 1A. In this embodiment, one heavy chain of the antibody contains an single chain Fv ("scFv", as defined below) and the other heavy chain is a "regular" FAb format, comprising a variable heavy chain and a light chain. This structure is sometimes referred to herein as "triple F" format (scFv-FAb-Fc) or the "bottle-opener" format, due to a rough visual similarity to a bottle-opener. The two chains are brought together by the use of amino acid variants in the constant regions (e.g., the Fc domain, the CH1 domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.).

Many of the embodiments outlined herein rely in general on the bottle opener format that comprises a first monomer comprising an scFv, comprising a variable heavy and a variable light domain, covalently attached using an scFv linker (charged, in many but not all instances), where the scFv is covalently attached to the N-terminus of a first Fc domain usually through a domain linker (which, as outlined herein can either be un-charged or charged). The second monomer of the bottle opener format is a heavy chain, and the composition further comprises a light chain.

In general, in many preferred embodiments, the scFv is the domain that binds to the CD3, and the Fab forms a SSTR2 binding domain.

In addition, the Fc domains of the invention generally comprise skew variants (e.g. a set of amino acid substitutions as shown in FIGS. 3 and 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L and K370S:S364K/E357Q), optionally ablation variants (including those shown in FIG. 5), optionally charged scFv linkers (including those shown in FIG. 7) and the heavy chain comprises pI variants (including those shown in FIG. 4).

In some embodiments, the bottle opener format includes skew variants, pI variants, and ablation variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, and an Fv that binds to CD3 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to SSTR2 as outlined herein; and c) a light chain.

Exemplary variable heavy and light domains of the scFv that binds to CD3 are included in FIGS. 12 and 13. Exemplary variable heavy and light domains of the Fv that binds to SSTR2 are included in FIG. 11. In an exemplary embodiment, the SSTR2 binding domain is an H1.143_L1.30 SSTR2 binding domain and the scFv that binds to CD3 includes the variable heavy and light domain of an H1.30_L1.47 CD3 binding domain. Other particularly useful SSTR2 and CD3 sequence combinations are disclosed FIG. 16.

In some embodiments, the bottle opener format includes skew variants, pI variants, ablation variants and FcRn variants. Accordingly, some embodiments include bottle opener formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, the FcRn variants M428L/N434S and an Fv that binds to CD3 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain that, with the variable light domain, makes up an Fv that binds to SSTR2 as outlined herein; and c) a light chain.

Exemplary variable heavy and light domains of scFvs that bind to CD3 are included in FIGS. 12 and 13. Exemplary variable heavy and light domains of the Fv that binds to SSTR2 are included in FIG. 11. In an exemplary embodiment, the SSTR2 binding domain includes the variable heavy and variable light domain of a H1.143_L1.30 SSTR2 binding domain and the scFv that binds to CD3 includes the variable heavy and light domain of an H1.30_L1.47 CD3 binding domain. Other particularly useful SSTR2 and CD3 sequence combinations are disclosed FIG. 16.

FIG. 9 shows some exemplary bottle opener "backbone" sequences that are missing the Fv sequences that can be used in the present invention. In some embodiments, any of the vh and vl sequences depicted herein (including all vh and vl sequences depicted in the Figures and Sequence Listings, including those directed to SSTR2) can be added to the bottle opener backbone formats of FIG. 9 as the "Fab side", using any of the anti-CD3 scFv sequences shown in the Figures and Sequence Listings.

For bottle opener backbone 1 from FIG. 9, (optionally including the 428L/434S variants), CD binding domain sequences finding particular use in these embodiments include, but are not limited to, CD3 binding domain anti-CD3 H1.30_L1.47, anti-CD3 H1.32—L1.47, anti-CD3 H1.89$_{13}$ L1.47, anti-CD3 H1.90$_{13}$ L1.47, anti-CD3 H1.33_L1.47 and anti-CD3 H1.31_L1.47, as well as those depicted in FIGS. 12 and 13, attached as the scFv side of the backbones shown in FIG. 9.

For bottle opener backbone 1 from FIG. 9, (optionally including the 428L/434S variants), SSTR2 binding domain sequences that are of particular use in these embodiments include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125_L1.102; and anti-SSTR2 H1.125_L1.10.

Particularly useful SSTR2 and CD3 sequence combinations for use with bottle opener backbone 1 from FIG. 9, (optionally including the 428L/434S variants), are disclosed in FIG. 16.

In one exemplary embodiment, the bottle opener antibody includes bottle opener "backbone" 1 from FIG. 9, the SSTR2 binding domain includes the variable heavy and light domain of an H1.143_L1.30 SSTR2 binding domain and the scFv that binds to CD3 includes the variable heavy and light domain of an H1.30_L1.47 CD3 binding domain.

mAb-Fv

One heterodimeric scaffold that finds particular use in the present invention is the mAb-Fv format shown in FIG. 1H. In this embodiment, the format relies on the use of a C-terminal attachment of an "extra" variable heavy domain to one monomer and the C-terminal attachment of an "extra" variable light domain to the other monomer, thus forming a third antigen binding domain, wherein the Fab portions of the two monomers bind a SSTR2 and the "extra" scFv domain binds CD3.

In this embodiment, the first monomer comprises a first heavy chain, comprising a first variable heavy domain and a first constant heavy domain comprising a first Fc domain, with a first variable light domain covalently attached to the C-terminus of the first Fc domain using a domain linker (vh1-CH1-hinge-CH2-CH3-[optional linker]-vl2). The second monomer comprises a second variable heavy domain of the second constant heavy domain comprising a second Fc domain, and a third variable heavy domain covalently attached to the C-terminus of the second Fc domain using a domain linker (vj1-CH1-hinge-CH2-CH3-[optional linker]-vh2. The two C-terminally attached variable domains make up a Fv that binds CD3 (as it is less preferred to have bivalent CD3 binding). This embodiment further utilizes a common light chain comprising a variable light domain and a constant light domain that associates with the heavy chains to form two identical Fabs that bind a SSTR2. As for many of the embodiments herein, these constructs include skew variants, pI variants, ablation variants, additional Fc variants, etc. as desired and described herein.

The present invention provides mAb-Fv formats where the CD binding domain sequences are as shown in FIGS. 12 and 13 and the Sequence Listing. The present invention provides mAb-Fv formats wherein the SSTR2 binding domain sequences are as shown in FIG. 11 and the Sequence Listing. Particularly useful SSTR2 and CD3 sequence combinations for use with the mAb-Fv format are disclosed FIG. 16.

In addition, the Fc domains of the mAb-Fv format comprise skew variants (e.g. a set of amino acid substitutions as shown in FIGS. 3 and 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-Fv format includes skew variants, pI variants, and ablation variants. Accordingly, some embodiments include mAb-Fv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to SSTR2, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to SSTR2 as outlined herein, and a second variable light chain, that together with the second variable heavy domain forms an Fv (ABD) that binds to CD3; and c) a light chain comprising a first variable light domain and a constant light domain.

In some embodiments, the mAb-Fv format includes skew variants, pI variants, ablation variants and FcRn variants. Accordingly, some embodiments include mAb-Fv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to SSTR2, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to SSTR2 as outlined herein, and a second variable light chain, that together with the second variable heavy domain of the first monomer forms an Fv (ABD) that binds CD3; and c) a light chain comprising a first variable light domain and a constant light domain.

For mAb-Fv sequences that are similar to the mAb-Fv backbone 1 from FIG. 10, (optionally including the M428L/434S variants), CD3 binding domain sequences finding particular use in these embodiments include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13.

For mAb-Fv sequences that are similar to the mAb-Fv backbone 1 from FIG. 10, (optionally including the M428L/434S variants), SSTR2 binding domain sequences that are of particular use in these embodiments include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125$_{13}$ L1.102; and anti-SSTR2 H1.125_L1.10, as well as those listed in FIGS. 11 and 15 and SEQ ID NOs: 68 to 659.

Particularly useful SSTR2 and CD3 sequence combinations for use with mAb-Fv sequences that are similar to the mAb-Fv backbone 1 from FIG. 10, (optionally including the 428L/434S variants), are disclosed FIG. 16.

mAb-scFv

One heterodimeric scaffold that finds particular use in the present invention is the mAb-scFv format shown in FIG. 1. In this embodiment, the format relies on the use of a C-terminal attachment of a scFv to one of the monomers, thus forming a third antigen binding domain, wherein the Fab portions of the two monomers bind SSTR2 and the "extra" scFv domain binds CD3. Thus, the first monomer comprises a first heavy chain (comprising a variable heavy domain and a constant domain), with a C-terminally covalently attached scFv comprising a scFv variable light domain, an scFv linker and a scFv variable heavy domain in either orientation (vh1-CH1-hinge-CH2-CH3-[optional linker]-vh2-scFv linker-vl2 or vh1-CH1-hinge-CH2-CH3-[optional linker]-vl2-scFv linker-vh2). This embodiment further utilizes a common light chain comprising a variable light domain and a constant light domain, that associates with the heavy chains to form two identical Fabs that bind SSTR2. As for many of the embodiments herein, these constructs include skew variants, pI variants, ablation variants, additional Fc variants, etc. as desired and described herein.

The present invention provides mAb-scFv formats where the CD binding domain sequences are as shown in FIGS. 12 and 13 and the Sequence Listing. The present invention provides mAb-scFv formats wherein the SSTR2 binding domain sequences are as shown in FIG. 11 and the Sequence Listing. Particularly useful SSTR2 and CD3 sequence combinations for use with the mAb-scFv format are disclosed FIG. 16.

In addition, the Fc domains of the mAb-scFv format comprise skew variants (e.g. a set of amino acid substitutions as shown in FIGS. 3 and 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-scFv format includes skew variants, pI variants, and ablation variants. Accordingly, some embodiments include mAb-scFv formats that comprise: a) a first monomer that comprises the skew variants S364K/E357Q, the ablation variants E233P/L234V/L235A/G236del/S267K, and a variable heavy domain that, with the variable light domain of the common light chain, makes up an Fv that binds to SSTR2 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to SSTR2 as outlined herein; and c) a common light chain comprising a variable light domain and a constant light domain.

In some embodiments, the mAb-scFv format includes skew variants, pI variants, ablation variants and FcRn variants. Accordingly, some embodiments include mAb-scFv formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to SSTR2 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to SSTR2 as outlined herein; and c) a common light chain comprising a variable light domain and a constant light domain.

In mAb-scFv backbone 1 (optionally including M428L/N434S) from FIG. 10, (optionally including the 428L/434S variants CD3 binding domain sequences finding particular use in these embodiments include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13.

In mAb-scFv backbone 1 (optionally including M428L/N434S) from FIG. 10, (optionally including the 428L/434S variants), SSTR2 binding domain sequences that are of particular use in these embodiments include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2

H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125$_{13}$ L1.102; and anti-SSTR2 H1.125_L1.10, as well as those listed in FIGS. 11 and 15 and SEQ ID NOs: 68 to 659.

Central-scFv

One heterodimeric scaffold that finds particular use in the present invention is the Central-scFv format shown in FIG. 1. In this embodiment, the format relies on the use of an inserted scFv domain thus forming a third antigen binding domain, wherein the Fab portions of the two monomers bind SSTR2 and the "extra" scFv domain binds CD3. The scFv domain is inserted between the Fc domain and the CH1-Fv region of one of the monomers, thus providing a third antigen binding domain.

In this embodiment, one monomer comprises a first heavy chain comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (vh1-CH1-[optional linker]-vh2-scFv linker-vl2-[optional linker including the hinge]-CH2-CH3, or the opposite orientation for the scFv, vh1-CH1-[optional linker]-vl2-scFv linker-vh2-[optional linker including the hinge]-CH2-CH3). The other monomer is a standard Fab side. This embodiment further utilizes a common light chain comprising a variable light domain and a constant light domain, that associates with the heavy chains to form two identical Fabs that bind SSTR2. As for many of the embodiments herein, these constructs include skew variants, pI variants, ablation variants, additional Fc variants, etc. as desired and described herein.

The present invention provides central-scFv formats where the CD3 binding domain sequences are as shown in FIGS. 12 and 13 and the Sequence Listing. The present invention provides central-scFv formats wherein the anti-SSTR2 sequences are as shown in FIG. 11 and the Sequence Listing. Particularly useful SSTR2 and CD3 sequence combinations for use with the central-scFv format are disclosed FIG. 16.

In addition, the Fc domains of the central scFv format comprise skew variants (e.g. a set of amino acid substitutions as shown in FIGS. 3 and 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/ Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the central-scFv format includes skew variants, pI variants, and ablation variants. Accordingly, some embodiments include central scFv formats that comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to SSTR2 as outlined herein, and an scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with variable light domain of the light chain, makes up an Fv that binds to SSTR2 as outlined herein; and c) a light chain comprising a variable light domain and a constant light domain.

In some embodiments, the central-scFv format includes skew variants, pI variants, ablation variants and FcRn variants. Accordingly, some embodiments include central scFv formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to SSTR2 as outlined herein, and an scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with variable light domain of the light chain, makes up an Fv that binds to SSTR2 as outlined herein; and c) a light chain comprising a variable light domain and a constant light domain.

For central-scFv sequences that are similar to/utilize the bottle opener backbone 1 of FIG. 9, (optionally including M428L/N434S), CD3 binding domain sequences finding particular use in these embodiments include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13.

For central-scFv sequences that are similar to/utilize the bottle opener backbone 1 of FIG. 9, (optionally including the M428L/434S variants), SSTR2 binding domain sequences that are of particular use in these embodiments include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125_L1.102; and anti-SSTR2 H1.125_L1.10, as well as those listed in FIGS. 11 and 15 and SEQ ID NOs: 68 to 659.

Central-Fv

One heterodimeric scaffold that finds particular use in the present invention is the Central-Fv format shown in FIG. 1G. In this embodiment, the format relies on the use of an inserted Fv domain (i.e., the central Fv domain) thus forming a third antigen binding domain, wherein the Fab portions of the two monomers bind a SSTR2 and the "central Fv" domain binds CD3. The scFv domain is inserted between the Fc domain and the CH1-Fv region of the monomers, thus providing a third antigen binding domain, wherein each monomer contains a component of the scFv (e.g. one monomer comprises a variable heavy domain and the other a variable light domain).

In this embodiment, one monomer comprises a first heavy chain comprising a first variable heavy domain, a CH1 domain, and Fc domain and an additional variable light domain. The light domain is covalently attached between the C-terminus of the CH1 domain of the heavy constant domain and the N-terminus of the first Fc domain using domain linkers (vh1-CH1-[optional linker]-vl2-hinge-CH2-CH3). The other monomer comprises a first heavy chain comprising a first variable heavy domain, a CH1 domain and Fc domain and an additional variable heavy domain (vh1-CH1-[optional linker]-vh2-hinge-CH2-CH3). The light domain is covalently attached between the C-terminus of the CH1 domain of the heavy constant domain and the N-terminus of the first Fc domain using domain linkers.

This embodiment further utilizes a common light chain comprising a variable light domain and a constant light domain, that associates with the heavy chains to form two identical Fabs that bind a SSTR2. As for many of the embodiments herein, these constructs include skew variants, pI variants, ablation variants, additional Fc variants, etc. as desired and described herein.

The present invention provides central-Fv formats where the CD3 binding domain sequences are as shown in FIGS. 12 and 13 and the Sequence Listing. The present invention provides central-Fv formats wherein the SSTR2 binding domain sequences are as shown in FIG. 11 and the Sequence Listing. Particularly useful SSTR2 and CD3 sequence combinations for use with the central-Fv format are disclosed FIG. 16.

For central-Fv formats, CD3 binding domain sequences finding particular use in these embodiments include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13.

For central-Fv formats, SSTR2 binding domain sequences that are of particular use in these embodiments include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125_L1.102; and anti-SSTR2 H1.125_L1.10, as well as those listed in FIGS. 11 and 15 and SEQ ID NOs: 68 to 659.

One Armed Central-scFv

One heterodimeric scaffold that finds particular use in the present invention is the one armed central-scFv format shown in FIG. 1. In this embodiment, one monomer comprises just an Fc domain, while the other monomer uses an inserted scFv domain thus forming the second antigen binding domain. In this format, either the Fab portion binds a SSTR2 and the scFv binds CD3 or vice versa. The scFv domain is inserted between the Fc domain and the CH1-Fv region of one of the monomers.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers. The second monomer comprises an Fc domain. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein.

The present invention provides central-Fv formats where the CD3 binding domain sequences are as shown in FIGS. 12 and 13 and the Sequence Listing. The present invention provides central-Fv formats wherein the SSTR2 binding domain sequences are as shown in FIG. 11 and the Sequence Listing. Particularly useful SSTR2 and CD3 sequence combinations for use with the central-Fv format are disclosed FIG. 16.

In addition, the Fc domains of the one armed central-scFv format generally include skew variants (e.g. a set of amino acid substitutions as shown in FIGS. 3 and 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the one armed central-scFv format includes skew variants, pI variants, and ablation variants. Accordingly, some embodiments of the one armed central-scFv formats comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to SSTR2 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K; and c) a light chain comprising a variable light domain and a constant light domain.

In some embodiments, the one armed central-scFv format includes skew variants, pI variants, ablation variants and FcRn variants. Accordingly, some embodiments of the one armed central-scFv formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to SSTR2 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

For one armed central-scFv formats, CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13.

For one armed central-scFv formats, SSTR2 binding domain sequences that are of particular use include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125_L1.102; and anti-SSTR2 H1.125_L1.10, as well as those listed in FIGS. 11 and 15 and SEQ ID NOs: 68 to 659.

One Armed scFv-mAb

One heterodimeric scaffold that finds particular use in the present invention is the one armed scFv-mAb format shown in FIG. 1D. In this embodiment, one monomer comprises just an Fc domain, while the other monomer uses a scFv domain attached at the N-terminus of the heavy chain, generally through the use of a linker: vh-scFv linker-vl-[optional domain linker]-CH1-hinge-CH2-CH3 or (in the opposite orientation) vl-scFv linker-vh-[optional domain linker]-CH1-hinge-CH2-CH3. In this format, the Fab portions each bind SSTR2 and the scFv binds CD3. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein.

The present invention provides one armed scFv-mAb formats where the CD3 binding domain sequences are as shown in FIGS. 12 and 13 and the Sequence Listing. The present invention provides one armed scFv-mAb formats wherein the SSTR2 binding domain sequences are as shown in FIG. 11 and the Sequence Listing. Particularly useful SSTR2 and CD3 sequence combinations for use with the one armed scFv-mAb format are disclosed FIG. 16.

In addition, the Fc domains of the one armed scFv-mAb format generally include skew variants (e.g. a set of amino acid substitutions as shown in FIGS. 3 and 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the one armed scFv-mAb format includes skew variants, pI variants, and ablation variants. Accordingly, some embodiments of the one armed scFv-mAb formats comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to SSTR2 as outlined herein, and a scFv domain that binds to CD3; b) a second monomer that includes an Fc domain having the skew variants L368D/K370S, the pI variants N208D/Q295E/ N384D/Q418E/N421D, the ablation variants E233P/L234V/ L235A/G236del/S267K; and c) a light chain comprising a variable light domain and a constant light domain.

In some embodiments, the one armed scFv-mAb format includes skew variants, pI variants, ablation variants and FcRn variants. Accordingly, some embodiments one armed scFv-mAb formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to SSTR2 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

For one armed scFv-mAb formats, CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13.

For one armed scFv-mAb formats, SSTR2 binding domain sequences that are of particular use include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125_L1.102; and anti-SSTR2 H1.125_L1.10, as well as those listed in FIGS. 11 and 15 and SEQ ID NOs: 68 to 659.

scFv-mAb

One heterodimeric scaffold that finds particular use in the present invention is the mAb-scFv format shown in FIG. 1E. In this embodiment, the format relies on the use of a N-terminal attachment of a scFv to one of the monomers, thus forming a third antigen binding domain, wherein the Fab portions of the two monomers bind SSTR2 and the "extra" scFv domain binds CD3.

In this embodiment, the first monomer comprises a first heavy chain (comprising a variable heavy domain and a constant domain), with a N-terminally covalently attached scFv comprising a scFv variable light domain, an scFv linker and a scFv variable heavy domain in either orientation ((vh1-scFv linker-vl1-[optional domain linker]-vh2-CH1-hinge-CH2-CH3) or (with the scFv in the opposite orientation) ((vl1-scFv linker-vh1-[optional domain linker]-vh2-CH1-hinge-CH2-CH3)). This embodiment further utilizes a common light chain comprising a variable light domain and a constant light domain that associates with the heavy chains to form two identical Fabs that bind SSTR2. As for many of the embodiments herein, these constructs include skew variants, pI variants, ablation variants, additional Fc variants, etc. as desired and described herein.

The present invention provides scFv-mAb formats where the CD3 binding domain sequences are as shown in FIGS. 12 and 13 and the Sequence Listing. The present invention provides scFv-mAb formats wherein the SSTR2 binding domain sequences are as shown in FIG. 11 and the Sequence Listing. Particularly useful SSTR2 and CD3 sequence combinations for use with the scFv-mAb format are disclosed FIG. 16.

In addition, the Fc domains of the scFv-mAb format generally include skew variants (e.g. a set of amino acid substitutions as shown in FIGS. 3 and 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the scFv-mAb format includes skew variants, pI variants, and ablation variants. Accordingly, some embodiments include scFv-mAb formats that comprise: a) a first monomer that comprises the skew variants S364K/E357Q, the ablation variants E233P/L234V/ L235A/G236del/S267K, and a variable heavy domain that, with the variable light domain of the common light chain, makes up an Fv that binds to SSTR2 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to SSTR2 as outlined herein; and c) a common light chain comprising a variable light domain and a constant light domain.

In some embodiments, the scFv-mAb format includes skew variants, pI variants, ablation variants and FcRn variants. Accordingly, some embodiments include scFv-mAb formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to SSTR2 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to SSTR2 as outlined herein; and c) a common light chain comprising a variable light domain and a constant light domain.

For the mAb-scFv format backbone 1 (optionally including M428L/N434S) from FIG. 10, CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13

For the mAb-scFv format backbone 1 (optionally including M428L/N434S) from FIG. 10, SSTR2 binding domain sequences that are of particular use include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125L1.111; anti-SSTR2 H1.125_L1.114; anti-SSTR2 H1.125_L1.102; and anti-SSTR2 H1.125_L1.10, as well as those listed in FIGS. 11 and 15 and SEQ ID NOs: 68 to 659.

Dual scFv Formats

The present invention also provides dual scFv formats as are known in the art and shown in FIG. 1B. In this embodiment, the SSTR2×CD3 heterodimeric bispecific antibody is made up of two scFv-Fc monomers (both in either (vh-scFv linker-vl-[optional domain linker]-CH2-CH3) format or (vl-scFv linker-vh-[optional domain linker]-CH2-CH3) format, or with one monomer in one orientation and the other in the other orientation.

The present invention provides dual scFv formats where the CD3 binding domain sequences are as shown in FIGS. 12 and 13 and the Sequence Listing. The present invention provides dual scFv formats wherein the SSTR2 binding domain sequences are as shown in FIG. 11 and the Sequence Listing. Particularly useful SSTR2 and CD3 sequence combinations for use with the dual scFv format are disclosed FIG. 16.

In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, and a first scFv that binds either CD3 or SSTR2; and b) a second monomer that comprises the skew variants L368D/K370S, the pI variants N208D/Q295E/N384D/Q418E/N421D, the ablation variants E233P/L234V/L235A/G236del/S267K, and a second scFv that binds either CD3 or SSTR2.

In some embodiments, the dual scFv format includes skew variants, pI variants, ablation variants and FcRn variants. In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, the FcRn variants M428L/N434S and a first scFv that binds either CD3 or SSTR2; and b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a second scFv that binds either CD3 or SSTR2.

For the dual scFv format, CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13.

For the dual scFv format, SSTR2 binding domain sequences that are of particular use include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125_L1.102; and anti-SSTR2 H1.125_L1.10, as well as those listed in FIGS. 11 and 15 and SEQ ID NOs: 68 to 659.

Monospecific, Monoclonal Antibodies

As will be appreciated by those in the art, the novel Fv sequences outlined herein can also be used in both monospecific antibodies (e.g. "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

I. Antigen Binding Domains to Target Antigens

The bispecific antibodies of the invention have two different antigen binding domains (ABDs) that bind to two different target checkpoint antigens ("target pairs"), in either bivalent, bispecific formats or trivalent, bispecific formats as generally shown in FIG. 1. Note that generally these bispecific antibodies are named "anti-SSTR2X anti-CD3", or generally simplistically or for ease (and thus interchangeably) as "SSTR2X CD3", etc. for each pair. Note that unless specified herein, the order of the antigen list in the name does not confer structure; that is a SSTR2X CD3 bottle opener antibody can have the scFv bind to SSTR2 or CD3, although in some cases, the order specifies structure as indicated.

As is more fully outlined herein, these combinations of ABDs can be in a variety of formats, as outlined below, generally in combinations where one ABD is in a Fab format and the other is in an scFv format. As discussed herein and shown in FIG. 1, some formats use a single Fab and a single scFv (FIGS. 1A, C and D), and some formats use two Fabs and a single scFv (FIGS. 1E, F, and I).

Antigen Binding Domains

As discussed herein, the subject heterodimeric antibodies include two antigen binding domains (ABDs), each of which bind to SSTR2 or CD3. As outlined herein, these heterodimeric antibodies can be bispecific and bivalent (each antigen is bound by a single ABD, for example, in the format depicted in FIG. 1A), or bispecific and trivalent (one antigen is bound by a single ABD and the other is bound by two ABDs, for example as depicted in FIG. 1F).

In addition, in general, one of the ABDs comprises a scFv as outlined herein, in an orientation from N- to C-terminus of vh-scFv linker-vl or vl-scFv linker-vh. One or both of the other ABDs, according to the format, generally is a Fab, comprising a vh domain on one protein chain (generally as a component of a heavy chain) and a vl on another protein chain (generally as a component of a light chain).

The invention provides a number of ABDs that bind to a number of different checkpoint proteins, as outlined below. As will be appreciated by those in the art, any set of 6 CDRs or vh and vl domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 7.

In addition, as discussed above, the numbering used in the Sequence Listing for the identification of the CDRs is Kabat, however, different numbering can be used, which will change the amino acid sequences of the CDRs as shown in Table 1.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g. from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g. there may be one change in vlCDR1, two in vhCDR2, none in vhCDR3, etc.)), as well as having framework region changes, as long as the framework regions retain at least 80, 85 or 90% identity to a human germline sequence selected from those listed in FIG. 1 of U.S. Pat. No. 7,657,380.

SSTR2 Antigen Binding Domains

In some embodiments, one of the ABDs binds SSTR2. Suitable sets of 6 CDRs and/or vh and vl domains, as well as scFv sequences, are depicted in FIG. 11 and the Sequence Listing. SSTR2 binding domain sequences that are of particular use include, but are not limited to, anti-SSTR2 H1.143_L1.30; anti-SSTR2 H1_L1.1; anti-SSTR2 H1.107_L1.30; anti-SSTR2 H1.107_L1.67; anti-SSTR2 H1.107_L1.108; anti-SSTR2 H1.107_L1.111; anti-SSTR2 H1.107_L1.114; anti-SSTR2 H1.107_L1.102; anti-SSTR2 H1.107_L1.110; anti-SSTR2 H1.125_L1.30; anti-SSTR2 H1.125_L1.67; Anti-SSTR2 H1.125_L1.108; anti-SSTR2 H1.125_L1.111; anti-SSTR2 H1.125_L1.114; anti-SSTR2 H1.125_L1.102; and anti-SSTR2 H1.125_L1.10, as well as those listed in FIGS. 11 and 15 and SEQ ID NOs: 68 to 659.

As will be appreciated by those in the art, suitable SSTR2 binding domains can comprise a set of 6 CDRs as depicted in the Sequence Listing and Figures, either as they are underlined or, in the case where a different numbering scheme is used as described herein and as shown in Table 1, as the CDRs that are identified using other alignments within the vh and vl sequences of those depicted in FIG. 11. Suitable ABDs can also include the entire vh and vl sequences as depicted in these sequences and Figures, used as scFvs or as Fabs. In many of the embodiments herein that contain an Fv to SSTR2, it is the Fab monomer that binds SSTR2.

In addition to the parental CDR sets disclosed in the figures and sequence listing that form an ABD to SSTR2, the invention provides variant CDR sets. In one embodiment, a set of 6 CDRs can have 1, 2, 3, 4 or 5 amino acid changes from the parental CDRs, as long as the SSTR2 ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to SSTR2, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

Specific preferred embodiments include the H1.143_L1.30 SSTR2 antigen binding domain, as a "Fab", included within any of the bottle opener format backbones of FIG. 9.

CD3 Antigen Binding Domains

In some embodiments, one of the ABDs binds CD3. Suitable sets of 6 CDRs and/or vh and vl domains, as well as scFv sequences, are depicted in FIGS. 12 and 13 and the Sequence Listing. CD3 binding domain sequences that are of particular use include, but are not limited to, anti-CD3 H1.30_L1.47, anti-CD3 H1.32_L1.47, anti-CD3

H1.89_L1.47, anti-CD3 H1.90_L1.47, anti-CD3 H1.33_L1.47 and anti-CD3 H1.31_L1.47, as well as those depicted in FIGS. 12 and 13.

As will be appreciated by those in the art, suitable CD3 binding domains can comprise a set of 6 CDRs as depicted in the Sequence Listing and Figures, either as they are underlined or, in the case where a different numbering scheme is used as described herein and as shown in Table 1, as the CDRs that are identified using other alignments within the vh and vl sequences of those depicted in FIG. 11. Suitable ABDs can also include the entire vh and vl sequences as depicted in these sequences and Figures, used as scFvs or as Fabs. In many of the embodiments herein that contain an Fv to CD3, it is the scFv monomer that binds CD3.

In addition to the parental CDR sets disclosed in the figures and sequence listing that form an ABD to CD3, the invention provides variant CDR sets. In one embodiment, a set of 6 CDRs can have 1, 2, 3, 4 or 5 amino acid changes from the parental CDRs, as long as the CD3 ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

In addition to the parental variable heavy and variable light domains disclosed herein that form an ABD to CD3, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured at least one of a Biacore, surface plasmon resonance (SPR) and/or BLI (biolayer interferometry, e.g. Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g. Octet assay) assay, with the latter finding particular use in many embodiments.

Specific preferred embodiments include the H1.30_L1.47 CD3 antigen binding domain, as a "Fab", included within any of the bottle opener format backbones of FIG. 9.

J. Useful Embodiments

In one embodiment, a particular combination of skew and pI variants that finds use in the present invention is T366S/L368A/Y407V:T366W (optionally including a bridging disulfide, T366S/L368A/Y407V/Y349C:T366W/S354C) with one monomer comprises Q295E/N384D/Q418E/N481D and the other a positively charged scFv linker (when the format includes an scFv domain). As will be appreciated in the art, the "knobs in holes" variants do not change pI, and thus can be used on either monomer.

K. Nucleic Acids of the Invention

The invention further provides nucleic acid compositions encoding the anti-SSTR2 antibodies provided herein, including, but not limited to, anti-SSTR2×anti-CD3 bispecific antibodies and SSTR2 monospecific antibodies.

As will be appreciated by those in the art, the nucleic acid compositions will depend on the format and scaffold of the heterodimeric protein. Thus, for example, when the format requires three amino acid sequences, such as for the triple F format (e.g. a first amino acid monomer comprising an Fc domain and a scFv, a second amino acid monomer comprising a heavy chain and a light chain), three nucleic acid sequences can be incorporated into one or more expression vectors for expression. Similarly, some formats (e.g. dual scFv formats such as disclosed in FIG. 1) only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extrachromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the present invention, each of these two or three nucleic acids are contained on a different expression vector. As shown herein and in 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The heterodimeric antibodies of the invention are made by culturing host cells comprising the expression vector(s) as is well known in the art. Once produced, traditional antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "triple F" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

L. Biological and Biochemical Functionality of the Heterodimeric Checkpoint Antibodies Generally the bispecific SSTR2×CD3 antibodies of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g. presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of the checkpoints on CD4+ T cell activation or proliferation, CD8+ T (CTL) cell activation or proliferation, CD8+ T cell-mediated cytotoxic activity and/or CTL mediated cell depletion, NK cell activity and NK mediated cell depletion.

In some embodiments, assessment of treatment is done by evaluating immune cell proliferation, using for example, CFSE dilution method, Ki67 intracellular staining of immune effector cells, and 3H-Thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, 51Cr or 35S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs.

Assays to Measure Efficacy

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in αβ and/or γδ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases αβ and/or γδ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells. as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFNγ, TNF-a, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFNγ and TNF), and cell surface receptor expression (e.g. CD25) would be indicative of immune modulation that would be consistent with enhanced killing of cancer cells.

In one embodiment, γδ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an antibody of the invention. Similarly, increases of at least one-, two-, three-, four- or five-fold as compared to reference or control samples show efficacy.

M. Treatments

Once made, the compositions of the invention find use in a number of applications. SSTR2 is high expressed in neuroendocrine tumors (NETs, e.g., lung, GI, pancreatic, pituitary, medullary cancers, prostate, pancreatic lungcarcinoids, osteosarcoma, bronchial, thymus) as well as non-NETs (breast, lung, colarectal, ovarian, cervial cancers).

Accordingly, the heterodimeric compositions of the invention find use in the treatment of such SSTR2 positive cancers.

Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

Administrative Modalities

The antibodies and chemotherapeutic agents of the invention are administered to a subject, in accord with known methods, such as intravenous administration as a bolus or by continuous infusion over a period of time.

Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

An exemplary, non-limiting range for a therapeutically effective amount of an bispecific antibody used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

Example 1

Generation of Anti-SSTR2X Anti-CD3 Bispecific Antibodies

1A: Generation of Anti-SSTR2 Fab Arm

The parental variable region of an anti-SSTR2 antibody was engineered for use as a component of anti-STTR2×anti-CD3 bispecific antibodies of the invention. Humanization of murine VH and VL regions was performed as previously described in U.S. Pat. No. 7,657,380, issued Feb. 2, 2010. Amino acid substitutions were made via QuikChange (Stratagene, Cedar Creek, Tx.) mutagenesis to attempt to identify variants with improved properties.

1B: Bispecifics Antibody Production

Cartoon schematics of anti-SSTR2×anti-CD3 bispecific formats are shown in FIG. 1. Exemplary antibodies were generated with anti-SSTR2 Fab arms derived from anti-SSTR2 antibodies engineered as described above and anti-CD3 scFv arms. Exemplary anti-SSTR2×anti-CD3 bottle opener antibodies XENP018087 and XENP018907 are shown in FIGS. 14 and 15, respectively. DNA encoding the three chains needed for bispecific expression were either generated by gene synthesis (Blue Heron Biotechnology, Bothell, Wash.) and standard subcloning into the expression vector pTT5 techniques or by QuikChange mutagenesis. DNA was transfected into HEK293E cells for expression, and the resulting proteins were purified from the supernatant using protein A affinity (GE Healthcare) and cation exchange chromatography. Cation exchange chromatography purification was performed using a HiTrap SP HP column (GE Healthcare) with a wash/equilibration buffer of 50 mM MES, pH 6.0 and an elution buffer of 50 mM MES, pH 6.0+1 M NaCl linear gradient.

1C: Anti-SSTR2 Antibody Bispecific Binding.

Cell surface binding of anti-SSTR2 antibodies and exemplary anti-SSTR2×anti-CD3 bispecific antibodies were assessed using human SSTR2-transfected CHO cells. Cells were incubated with indicated test articles for 45 minutes on ice and centrifuged. Cells were resuspended with staining buffer containing phycoerythrin (PE) labeled secondary antibody (2 µg/mL; goat anti-human IgG) and then incubated for 45 minutes on ice. Cells were centrifuged twice and then resuspsended with staining buffer. Binding was measured by flow cytometry (FIGS. 17A-P).

Example 2

Characterization of Exemplary Anti-SSTR2× Anti-CD3 Bispecific Antibodies

2A: In vitro Characterization of Exemplary Anti-SSTR2× Anti-CD3 Bispecific Antibodies Exemplary anti-SSTR2×anti-CD3 Fab-scFv-Fc bispecifics were characterized in vitro for redirected T cell cytotoxicity (RTCC) on SSTR2 transfected CHO cells (FIGS. 18A-D) and SSTR2-positive TT cells (a human thyroid medullary carcinoma cell line; FIGS. 19A-C). RTCC was determined by measuring lactate dehydrogenase (LDH) levels. As shown in these figures, anti-SSTR2×anti-CD3 Fab-scFv-Fc bispecifics exhibited a high percentage of RTCC in the SSTR2-transfected CHO cells, as well as the human cancer cell lines as compared to controls.

2B: In vivo Characterization of Exemplary Anti-SSTR2× Anti-CD3 Bispecific Antibodies In a first study, cynomolgus monkeys (n=3) were administered two (at 0 and 3 weeks) intravenous (i.v.) doses of either 0.03 mg/kg XENP18087 or 1 mg/kg XENP18088. The effects of these anti-SSTR2×anti-CD3 bispecific antibodies on $CD4^+$ and $CD8^+$ T cell activation as indicated by CD69 expression (FIG. 20A) and $CD4^+$ and $CD8^+$ T cell distribution (FIG. 20B) were subsequently assessed.

In a second study, cynomolgus monkeys (n=3) were administered a single intravenous (i.v.) dose of anti-SSTR2× anti-CD3 bispecific antibodies: 0.06 mg/kg XENP18087, 0.1 mg/kg XENP18907, 0.5 mg/kg XENP18907, or 2 mg/kg XENP18907. The effects of these anti-SSTR2×anti-CD3 bispecific antibodies on $CD4^+$ and $CD8^+$ T cell activation (CD69 upregulation, FIG. 21A) and $CD4^+$ and $CD8^+$ T cell redistribution (cell counts, FIG. 21B) were assessed. In addition, a glucose tolerance test (GTT) was conducted (FIGS. 21C and 21D) to assess the ability of the tested subjects to breakdown glucose. For the GTT, blood samples were collected at 8 different time points: predose, 5, 10, 20, 30, 40, 60, and 90 minutes after dextrose administration. As shown in these studies, $CD4^+$ and $CD8^+$ were rapidly redistributed from the blood during each treatment with subsequence recovery and normalization after dosing (FIG. 21B). T cells were activated immediately upon dosing (FIG. 21A) and then subsequently subsided, coincident with T cell redistribution.

In a third study, cynomolgus monkeys (n=3) were administered two (at 0 and 1 week) intravenous (i.v.) doses of either 0.001 or 0.01 mg/kg XENP18087. The effects of these anti-SSTR2×anti-CD3 bispecific antibodies on $CD4^+$ and $CD8^+$ T cell activation (FIGS. 22A-B) and $CD4^+$ and $CD8^+$ T cell distribution (FIGS. 22C-D) were subsequently assessed using CD69 expression, a marker of T cell activation. From these monkeys, serum IL-6 and TNF levels were assayed (FIGS. 22 E-F). As shown in these studies, $CD4^+$ and $CD8^+$ were rapidly redistributed from the blood during each treatment with subsequent recovery and normalization after dosing. T cells were activated immediately upon each administration in a dose-dependent manner and then subsequently subsided, coincident with T cell redistribution. IL-6 and TNF cytokine release correlated with T cell activation.

Example 3

Evaluation of XmAb18087

3A: Specific Binding of XmAb18087 for Human and Cynomolgus SSTR2

Cell surface binding of XmAb18087 and control anti-RSV×anti-CD3 bispecific antibody (XENP13245) were assessed using humanSSTR2-transfected CHO cells and cynoSSTR2-transfected CHO cells. Cell surface binding was also assessed using parental CHO cells as control. Binding was measured by flow cytometry using phycoerythrin (PE) labeled secondary antibody as generally described in Example 1C.

XmAb18087 not only bound cell surface human SSTR2 (FIG. 23A) but was also cross-reactive with cynomolgus SSTR2 (FIG. 23B), while the control anti-RSV×anti-CD3 bispecific antibody XENP13245 did not bind either human SSTR2 or cynomolgus SSTR2-transfected CHO cells. The data further shows that XmAb18087 did not bind untransfected parental CHO cells (FIG. 23C) demonstrating the specificity of XmAb18087.

3B: Redirected T Cell Cytotoxicity by XmAb18087

XmAb18087 was characterized in vitro for redirected T cell cytotoxicity (RTCC) of SSTR2-transfected CHO cells (FIG. 24A), SSTR2-positive TT cells (a medullary thyroid carcinoma cell line; FIGS. 24B and 25), A549 cells (a lung adenocarcinoma cell line; FIGS. 24C and 25) and untransfected parental CHO cell as a control (FIG. 24A). An anti-RSV×anti-CD3 bispecific antibody (XENP13245) and bivalent anti-SSTR2 mAb were included as controls (FIG. 24D).

Target cells and human PBMCs were incubated with XmAb18087 or XENP13245 for 24 hours at an E:T ratio of 10 or 20:1. RTCC was determined by measuring lactate dehydrogenase (LDH) levels.

As shown in these figures, XmAb18087 exhibited a high percentage of RTCC in the SSTR2 transfected CHO cells (FIG. 24A) as well as the human cancer cell lines (FIGS. 28B-C and 24D) as compared to the control anti-CD3 bispecific antibody XENP13245 and control bivalent anti-SSTR2 mAb (FIG. 25). Furthermore, the data show that XmAb18087 did not exhibit RTCC in untransfected parental CHO cells (FIG. 24A).

T cell activation by XmAb18087 was also investigated in the experiments with SSTR2-transfected CHO cells and TT cells by evaluating the surface expression of CD69 on $CD8^+$ and $CD4^+$ T cells by flow cytometry (FIG. 26A-B). As shown in the figures, XmAb18087 activates $CD8^+$ and CD4+ T cells to a much higher level than the control anti-CD3 bispecific antibody XENP13245. This demonstrates the XmAb18087 eliminates $SSTR2^+$ target cells by inducing T cell activation.

3C: XmAb18087 Exhibits Anti-Tumor Activity in NSG Mice Engrafted with A549 Lung Carcinoma Cells and Human PBMC Twenty-five NOD scid gamma (NSG) mice were each engrafted with $1 \times 10^6$ A549-RedFLuc tumor cells (0.1 mL volume subcutaneous injection) on Day −7. On Day 0, mice were engrafted intraperitoneally with $10 \times 10^6$ human PBMCs. After PBMC engraftment on Day 0, XmAb18087 was dosed weekly (Days 0, 7, and 14) by intraperitoneal injection at 3.0 mg/kg (control mice were dosed with PBS). Study design is further summarized in FIG. 27. Tumor growth was monitored by measuring total flux per mouse using an in vitro imaging system (IVIS® Lumina III).

As shown in FIGS. 28 and 29, treatment with 3 mg/kg XmAb18087 substantially suppresses A549 local tumor growth as compared to treatment with PBS.

3D: Characterization of XmAb18087 in Cynomolgus Monkeys

In a further study, cynomolgus monkeys (n=3) were administered a single intravenous (i.v.) dose of XmAb18087 or control anti-RSV×anti-CD3 bispecific antibody (XENP13245). The effects of these bispecific antibodies on $CD4^+$ and $CD8^+$ T cell activation (CD69 upregulation; FIGS. 31A-B), and cytokine (IL-6 and TNF) release (FIGS. 32A-B) were assessed.

As shown in the figures, $CD4^+$ and $CD8^+$ T cells were rapidly redistributed from the blood following treatment with XmAb18087 (FIGS. 30A and B, as compared to treatment with XENP13245) with subsequent recovery and normalizing after dosing. T cells were activated immediately upon dosing with XmAb18087 (as compared to dosing with XENP13245) and then subsequently subsided, coincident with T cell redistribution. Further, IL-6 and TNF cytokine release correlated with T cell activation (FIGS. 32A-B).

3E: Characterization of XmAb18087 in NSG Mice

In another study to investigate dose-response, 60 NSG mice were engrafted with 1×106 A549-RedFLuc tumor cells (0.1 mL volume subcutaneous injection) on Day −7. On Day 0, mice were sorted based on total flux and engrafted intraperitoneally with 10×106 human PBMCs and administered Dose #1 of test articles at the indicated concentrations (12 mice for each concentration). Dose #2 and #3 were administered on Day 8 and Day 15. As above, tumor growth was monitored by measuring total flux per mouse using an in vitro imaging system two to three times per week as depicted in FIG. 33. Additionally, tumor volume was measured by caliper once to twice per week as depicted in Figure X for Day 18 and 22 post Dose #1.

---

SEQUENCE LISTING (1143 sequences)

SEQ ID NO: 1 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 2 - protein, 5 aa, Artificial Sequence
  Description of Artificial Sequence: Synthetic peptide
TYAMN

SEQ ID NO: 3 - protein, 19 aa, Artificial Sequence
  Description of Artificial Sequence: Synthetic peptide
RIRSKYNNYATYYADSVKG

SEQ ID NO: 4 - protein, 14 aa, Artificial Sequence
  Description of Artificial Sequence: Synthetic peptide
HGNFGDSYVSWFAY

SEQ ID NO: 5 - protein, 109 aa, Artificial Sequence
  Description of Artificial Sequence: Synthetic polypeptide
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 6 - protein, 14 aa, Artificial Sequence
  Description of Artificial Sequence: Synthetic peptide
GSSTGAVTTSNYAN

SEQ ID NO: 7 - protein, 7 aa, Artificial Sequence
  Description of Artificial Sequence: Synthetic peptide
GTNKRAP

SEQ ID NO: 8 - protein, 9 aa, Artificial Sequence
  Description of Artificial Sequence: Synthetic peptide
ALWYSNHWV

SEQ ID NO: 9 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 10 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 11 - protein, 5 aa, Artificial Sequence
  Description of Artificial Sequence: Synthetic peptide
TYAMN

SEQ ID NO: 12 - protein, 19 aa, Artificial Sequence
  Description of Artificial Sequence: Synthetic peptide
RIRSKANNYATYYADSVKG

SEQ ID NO: 13 - protein, 14 aa, Artificial Sequence
  Description of Artificial Sequence: Synthetic peptide
HGNFGDSYVSWFAY

SEQ ID NO: 14 - protein, 109 aa, Artificial Sequence; identical to SEQ ID NO: 5
  Description of Artificial Sequence: Synthetic polypeptide

SEQ ID NO: 15 - protein, 14 aa, Artificial Sequence
  Description of Artificial Sequence: Synthetic peptide
GSSTGAVTTSNYAN

SEQ ID NO: 16 - protein, 7 aa, Artificial Sequence
  Description of Artificial Sequence: Synthetic peptide
GTNKRAP

SEQ ID NO: 17 - protein, 9 aa, Artificial Sequence
  Description of Artificial Sequence: Synthetic peptide
ALWYSNHWV

SEQ ID NO: 18 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 19 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 20 - protein, 5 aa, Artificial Sequence
  Description of Artificial Sequence: Synthetic peptide
TYAMN

SEQ ID NO: 21 - protein, 19 aa, Artificial Sequence
  Description of Artificial Sequence: Synthetic peptide
RIRSKYNNYATYYADSVKG

SEQ ID NO: 22 - protein, 14 aa, Artificial Sequence
  Description of Artificial Sequence: Synthetic peptide
HGNFGDEYVSWFAY

SEQ ID NO: 23 - protein, 109 aa, Artificial Sequence; identical to SEQ ID NO: 5
  Description of Artificial Sequence: Synthetic polypeptide

SEQ ID NO: 24 - protein, 14 aa, Artificial Sequence
  Description of Artificial Sequence: Synthetic peptide
GSSTGAVTTSNYAN

SEQ ID NO: 25 - protein, 7 aa, Artificial Sequence
  Description of Artificial Sequence: Synthetic peptide
GTNKRAP

SEQ ID NO: 26 - protein, 9 aa, Artificial Sequence
  Description of Artificial Sequence: Synthetic peptide
ALWYSNHWV

SEQ ID NO: 27 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 28 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 29 - protein, 5 aa, Artificial Sequence
  Description of Artificial Sequence: Synthetic peptide
TYAMN

SEQ ID NO: 30 - protein, 19 aa, Artificial Sequence
  Description of Artificial Sequence: Synthetic peptide
RIRSKYNNYATYYADSVKG

SEQ ID NO: 31 - protein, 14 aa, Artificial Sequence
  Description of Artificial Sequence: Synthetic peptide
HGNFGDPYVSWFAY

SEQ ID NO: 32 - protein, 109 aa, Artificial Sequence; identical to SEQ ID NO: 5
  Description of Artificial Sequence: Synthetic polypeptide

SEQ ID NO: 33 - protein, 14 aa, Artificial Sequence
  Description of Artificial Sequence: Synthetic peptide
GSSTGAVTTSNYAN

SEQ ID NO: 34 - protein, 7 aa, Artificial Sequence
  Description of Artificial Sequence: Synthetic peptide
GTNKRAP

SEQ ID NO: 35 - protein, 9 aa, Artificial Sequence
  Description of Artificial Sequence: Synthetic peptide
ALWYSNHWV

SEQ ID NO: 36 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 37 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 38 - protein, 5 aa, Artificial Sequence
  Description of Artificial Sequence: Synthetic peptide
TYAMN

SEQ ID NO: 39 - protein, 19 aa, Artificial Sequence
  Description of Artificial Sequence: Synthetic peptide
RIRSKYNNYATYYADSVKG

SEQ ID NO: 40 - protein, 14 aa, Artificial Sequence
  Description of Artificial Sequence: Synthetic peptide
HGNFGDSYVSWFDY

SEQ ID NO: 41 - protein, 109 aa, Artificial Sequence; identical to SEQ ID NO: 5
  Description of Artificial Sequence: Synthetic polypeptide

SEQ ID NO: 42 - protein, 14 aa, Artificial Sequence
  Description of Artificial Sequence: Synthetic peptide
GSSTGAVTTSNYAN

SEQ ID NO: 43 - protein, 7 aa, Artificial Sequence
  Description of Artificial Sequence: Synthetic peptide
GTNKRAP

SEQ ID NO: 44 - protein, 9 aa, Artificial Sequence
  Description of Artificial Sequence: Synthetic peptide
ALWYSNHWV

SEQ ID NO: 45 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 46 - protein, 125 aa, Artificial Sequence
  Description of Artificial Sequence: Synthetic polypeptide
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 47 - protein, 5 aa, Artificial Sequence
  Description of Artificial Sequence: Synthetic peptide
TYAMS

SEQ ID NO: 48 - protein, 19 aa, Artificial Sequence
  Description of Artificial Sequence: Synthetic peptide
RIRSKYNNYATYYADSVKG

SEQ ID NO: 49 - protein, 14 aa, Artificial Sequence
  Description of Artificial Sequence: Synthetic peptide
HGNFGDSYVSWFAY

SEQ ID NO: 50 - protein, 109 aa, Artificial Sequence; identical to SEQ ID NO: 5
  Description of Artificial Sequence: Synthetic polypeptide

SEQ ID NO: 51 - protein, 14 aa, Artificial Sequence
  Description of Artificial Sequence: Synthetic peptide
GSSTGAVTTSNYAN

SEQ ID NO: 52 - protein, 7 aa, Artificial Sequence
  Description of Artificial Sequence: Synthetic peptide
GTNKRAP

SEQ ID NO: 53 - protein, 9 aa, Artificial Sequence
  Description of Artificial Sequence: Synthetic peptide
ALWYSNHWV

SEQ ID NO: 54 - protein, 254 aa, Artificial Sequence
  Description of Artificial Sequence: Synthetic polypeptide
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 55 - protein, 20 aa, Artificial Sequence
  Description of Artificial Sequence: Synthetic peptide
GKPGSGKPGSGKPGSGKPGS

SEQ ID NO: 56 - protein, 6 aa, Artificial Sequence
  Description of Artificial Sequence: Synthetic 6xHis tag
HHHHHH

SEQ ID NO: 57 - protein, 4 aa, Artificial Sequence
  Description of Artificial Sequence: Synthetic peptide
DEDE

SEQ ID NO: 58 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPNRFTGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 60 - protein, 452 aa, Artificial Sequence; identical to SEQ ID NO: 58
  Description of Artificial Sequence: Synthetic polypeptide

SEQ ID NO: 61 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 452 aa, Artificial Sequence; identical to SEQ ID NO: 58
  Description of Artificial Sequence: Synthetic polypeptide

SEQ ID NO: 63 - protein, 219 aa, Artificial Sequence
  Description of Artificial Sequence: Synthetic polypeptide
DIVMTQTPLSLSVTPGQPASISCKSSQSLLNSRTRKNYLAWYQQKPGQSPQLLIYWASTRESGVPNRFTGSGSGTDFTLKISRVEAEDVGVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 64 - protein, 452 aa, Artificial Sequence; identical to SEQ ID NO: 58
  Description of Artificial Sequence: Synthetic polypeptide

SEQ ID NO: 65 - protein, 219 aa, Artificial Sequence
  Description of Artificial Sequence: Synthetic polypeptide
DIVMTQTPLSLSVTPGQPASISCKSSQSLLNSRTRKNYLAWYQQKPGQSPQLLIYWASTRESGVPDRFSGSGSGTDFTLKISRVEAEDVGVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 452 aa, Artificial Sequence
  Description of Artificial Sequence: Synthetic polypeptide
EVQLVESGGGLVQPGGSLRLSCAASGFTFSDYGMAWVRQAPGKGLEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 219 aa, Artificial Sequence; identical to SEQ ID NO: 59
  Description of Artificial Sequence: Synthetic polypeptide

SEQ ID NO: 68 - protein, 452 aa, Artificial Sequence; identical to SEQ ID NO: 66
  Description of Artificial Sequence: Synthetic polypeptide

SEQ ID NO: 69 - protein, 219 aa, Artificial Sequence; identical to SEQ ID NO: 61
  Description of Artificial Sequence: Synthetic polypeptide

SEQ ID NO: 70 - protein, 452 aa, Artificial Sequence; identical to SEQ ID NO: 66
  Description of Artificial Sequence: Synthetic polypeptide

SEQ ID NO: 71 - protein, 219 aa, Artificial Sequence; identical to SEQ ID NO: 63
  Description of Artificial Sequence: Synthetic polypeptide

SEQ ID NO: 72 - protein, 452 aa, Artificial Sequence; identical to SEQ ID NO: 66
  Description of Artificial Sequence: Synthetic polypeptide

SEQ ID NO: 73 - protein, 219 aa, Artificial Sequence; identical to SEQ ID NO: 65
  Description of Artificial Sequence: Synthetic polypeptide

SEQ ID NO: 74 - protein, 452 aa, Artificial Sequence
  Description of Artificial Sequence: Synthetic polypeptide
QVQLVESGGGLVKPGGSLKLSCAASGFTFSDYGMAWFRQAPGKGPEWVAFISNLAYSIYYADSVKGRFTISRDNSKNTLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 219 aa, Artificial Sequence; identical to SEQ ID NO: 59
  Description of Artificial Sequence: Synthetic polypeptide

SEQ ID NO: 76 - protein, 452 aa, Artificial Sequence; identical to SEQ ID NO: 74
  Description of Artificial Sequence: Synthetic polypeptide

SEQ ID NO: 77 - protein, 219 aa, Artificial Sequence; identical to SEQ ID NO: 61
  Description of Artificial Sequence: Synthetic polypeptide

SEQ ID NO: 78 - protein, 452 aa, Artificial Sequence; identical to SEQ ID NO: 74
  Description of Artificial Sequence: Synthetic polypeptide

SEQ ID NO: 79 - protein, 219 aa, Artificial Sequence; identical to SEQ ID NO: 63
  Description of Artificial Sequence: Synthetic polypeptide

SEQ ID NO: 80 - protein, 452 aa, Artificial Sequence; identical to SEQ ID NO: 74
  Description of Artificial Sequence: Synthetic polypeptide

SEQ ID NO: 81 - protein, 219 aa, Artificial Sequence; identical to SEQ ID NO: 65
  Description of Artificial Sequence: Synthetic polypeptide

SEQ ID NO: 82 - protein, 452 aa, Artificial Sequence
  Description of Artificial Sequence: Synthetic polypeptide
QVQLVESGGGLVKPGGSLKLSCAASGFTFSDYGMAWVRQAPGKGLEWVAFISNLAYSIYYADSVKGRFTISRDNSKNTLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 219 aa, Artificial Sequence; identical to SEQ ID NO: 59
  Description of Artificial Sequence: Synthetic polypeptide

SEQ ID NO: 84 - protein, 452 aa, Artificial Sequence; identical to SEQ ID NO: 82
  Description of Artificial Sequence: Synthetic polypeptide

SEQ ID NO: 85 - protein, 219 aa, Artificial Sequence; identical to SEQ ID NO: 61
  Description of Artificial Sequence: Synthetic polypeptide

SEQ ID NO: 86 - protein, 452 aa, Artificial Sequence; identical to SEQ ID NO: 82
  Description of Artificial Sequence: Synthetic polypeptide

SEQ ID NO: 87 - protein, 219 aa, Artificial Sequence; identical to SEQ ID NO: 63
  Description of Artificial Sequence: Synthetic polypeptide

SEQ ID NO: 88 - protein, 452 aa, Artificial Sequence; identical to SEQ ID NO: 82
  Description of Artificial Sequence: Synthetic polypeptide

SEQ ID NO: 89 - protein, 219 aa, Artificial Sequence; identical to SEQ ID NO: 65
  Description of Artificial Sequence: Synthetic polypeptide

SEQ ID NO: 90 - protein, 452 aa, Artificial Sequence; identical to SEQ ID NO: 58
  Description of Artificial Sequence: Synthetic polypeptide

SEQ ID NO: 91 - protein, 219 aa, Artificial Sequence
  Description of Artificial Sequence: Synthetic polypeptide
EIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 452 aa, Artificial Sequence; identical to SEQ ID NO: 58
  Description of Artificial Sequence: Synthetic polypeptide

SEQ ID NO: 93 - protein, 219 aa, Artificial Sequence
  Description of Artificial Sequence: Synthetic polypeptide
DIVMTQSPDSLAVSLGERATINCKSSQSLDNSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 452 aa, Artificial Sequence; identical to SEQ ID NO: 58
  Description of Artificial Sequence: Synthetic polypeptide

SEQ ID NO: 95 - protein, 219 aa, Artificial Sequence
  Description of Artificial Sequence: Synthetic polypeptide
DIVMTQSPDSLAVSLGERATINCKSSQSLINSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 96 - protein, 452 aa, Artificial Sequence; identical to SEQ ID NO: 58
  Description of Artificial Sequence: Synthetic polypeptide

SEQ ID NO: 97 - protein, 219 aa, Artificial Sequence
  Description of Artificial Sequence: Synthetic polypeptide
DIVMTQSPDSLAVSLGERATINCKSSQSLRNSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 452 aa, Artificial Sequence; identical to SEQ ID NO: 58
  Description of Artificial Sequence: Synthetic polypeptide

SEQ ID NO: 99 - protein, 219 aa, Artificial Sequence
  Description of Artificial Sequence: Synthetic polypeptide
DIVMTQSPDSLAVSLGERATINCKSSQSLSNSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 100 - protein, 452 aa, Artificial Sequence; identical to SEQ ID NO: 58
  Description of Artificial Sequence: Synthetic polypeptide

SEQ ID NO: 101 - protein, 219 aa, Artificial Sequence
  Description of Artificial Sequence: Synthetic polypeptide
DIVMTQSPDSLAVSLGERATINCKSSQSLVNSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 452 aa, Artificial Sequence; identical to SEQ ID NO: 58
  Description of Artificial Sequence: Synthetic polypeptide

SEQ ID NO: 103 - protein, 219 aa, Artificial Sequence
  Description of Artificial Sequence: Synthetic polypeptide
DIVMTQSPDSLAVSLGERATINCKSSQSLLDSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 452 aa, Artificial Sequence; identical to SEQ ID NO: 58
  Description of Artificial Sequence: Synthetic polypeptide

SEQ ID NO: 105 - protein, 219 aa, Artificial Sequence
  Description of Artificial Sequence: Synthetic polypeptide
DIVMTQSPDSLAVSLGERATINCKSSQSLLHSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 452 aa, Artificial Sequence; identical to SEQ ID NO: 58
  Description of Artificial Sequence: Synthetic polypeptide

SEQ ID NO: 107 - protein, 219 aa, Artificial Sequence
  Description of Artificial Sequence: Synthetic polypeptide
DIVMTQSPDSLAVSLGERATINCKSSQSLLQSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 108 - protein, 452 aa, Artificial Sequence; identical to SEQ ID NO: 58
  Description of Artificial Sequence: Synthetic polypeptide

SEQ ID NO: 109 - protein, 219 aa, Artificial Sequence
  Description of Artificial Sequence: Synthetic polypeptide
DIVMTQSPDSLAVSLGERATINCKSSQSLLRSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 452 aa, Artificial Sequence; identical to SEQ ID NO: 58
  Description of Artificial Sequence: Synthetic polypeptide

SEQ ID NO: 111 - protein, 219 aa, Artificial Sequence
  Description of Artificial Sequence: Synthetic polypeptide
DIVMTQSPDSLAVSLGERATINCKSSQSLLYSRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 452 aa, Artificial Sequence; identical to SEQ ID NO: 58
  Description of Artificial Sequence: Synthetic polypeptide

SEQ ID NO: 113 - protein, 219 aa, Artificial Sequence
  Description of Artificial Sequence: Synthetic polypeptide
DIVMTQSPDSLAVSLGERATINCKSSQSLLNARTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 114 - protein, 452 aa, Artificial Sequence; identical to SEQ ID NO: 58
  Description of Artificial Sequence: Synthetic polypeptide

SEQ ID NO: 115 - protein, 219 aa, Artificial Sequence
  Description of Artificial Sequence: Synthetic polypeptide
DIVMTQSPDSLAVSLGERATINCKSSQSLLNDRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 116 - protein, 452 aa, Artificial Sequence; identical to SEQ ID NO: 58
  Description of Artificial Sequence: Synthetic polypeptide

SEQ ID NO: 117 - protein, 219 aa, Artificial Sequence
  Description of Artificial Sequence: Synthetic polypeptide
DIVMTQSPDSLAVSLGERATINCKSSQSLLNHRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 118 - protein, 452 aa, Artificial Sequence; identical to SEQ ID NO: 58
  Description of Artificial Sequence: Synthetic polypeptide

SEQ ID NO: 119 - protein, 219 aa, Artificial Sequence
  Description of Artificial Sequence: Synthetic polypeptide
DIVMTQSPDSLAVSLGERATINCKSSQSLLNKRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 120 - protein, 452 aa, Artificial Sequence; identical to SEQ ID NO: 58
  Description of Artificial Sequence: Synthetic polypeptide

SEQ ID NO: 121 - protein, 219 aa, Artificial Sequence
  Description of Artificial Sequence: Synthetic polypeptide
DIVMTQSPDSLAVSLGERATINCKSSQSLLNQRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 452 aa, Artificial Sequence; identical to SEQ ID NO: 58
  Description of Artificial Sequence: Synthetic polypeptide

SEQ ID NO: 123 - protein, 219 aa, Artificial Sequence
  Description of Artificial Sequence: Synthetic polypeptide
DIVMTQSPDSLAVSLGERATINCKSSQSLLNTRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 124 - protein, 452 aa, Artificial Sequence; identical to SEQ ID NO: 58
  Description of Artificial Sequence: Synthetic polypeptide

SEQ ID NO: 125 - protein, 219 aa, Artificial Sequence
  Description of Artificial Sequence: Synthetic polypeptide
DIVMTQSPDSLAVSLGERATINCKSSQSLLNVRTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 452 aa, Artificial Sequence; identical to SEQ ID NO: 58
  Description of Artificial Sequence: Synthetic polypeptide

SEQ ID NO: 127 - protein, 219 aa, Artificial Sequence
  Description of Artificial Sequence: Synthetic polypeptide
DIVMTQSPDSLAVSLGERATINCKSSQSLLNSDTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 128 - protein, 452 aa, Artificial Sequence; identical to SEQ ID NO: 58
  Description of Artificial Sequence: Synthetic polypeptide

SEQ ID NO: 129 - protein, 219 aa, Artificial Sequence
  Description of Artificial Sequence: Synthetic polypeptide
DIVMTQSPDSLAVSLGERATINCKSSQSLLNSKTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 130 - protein, 452 aa, Artificial Sequence; identical to SEQ ID NO: 58
  Description of Artificial Sequence: Synthetic polypeptide

SEQ ID NO: 131 - protein, 219 aa, Artificial Sequence
  Description of Artificial Sequence: Synthetic polypeptide
DIVMTQSPDSLAVSLGERATINCKSSQSLLNSLTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 132 - protein, 452 aa, Artificial Sequence; identical to SEQ ID NO: 58
  Description of Artificial Sequence: Synthetic polypeptide

SEQ ID NO: 133 - protein, 219 aa, Artificial Sequence
  Description of Artificial Sequence: Synthetic polypeptide
DIVMTQSPDSLAVSLGERATINCKSSQSLLNSNTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 134 - protein, 452 aa, Artificial Sequence; identical to SEQ ID NO: 58
  Description of Artificial Sequence: Synthetic polypeptide

SEQ ID NO: 135 - protein, 219 aa, Artificial Sequence
  Description of Artificial Sequence: Synthetic polypeptide
DIVMTQSPDSLAVSLGERATINCKSSQSLLNSQTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - protein, 452 aa, Artificial Sequence; identical to SEQ ID NO: 58
  Description of Artificial Sequence: Synthetic polypeptide

SEQ ID NO: 137 - protein, 219 aa, Artificial Sequence
  Description of Artificial Sequence: Synthetic polypeptide
DIVMTQSPDSLAVSLGERATINCKSSQSLLNSVTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 452 aa, Artificial Sequence; identical to SEQ ID NO: 58
  Description of Artificial Sequence: Synthetic polypeptide

SEQ ID NO: 139 - protein, 219 aa, Artificial Sequence
  Description of Artificial Sequence: Synthetic polypeptide
DIVMTQSPDSLAVSLGERATINCKSSQSLLNSYTRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 140 - protein, 452 aa, Artificial Sequence; identical to SEQ ID NO: 58
  Description of Artificial Sequence: Synthetic polypeptide

SEQ ID NO: 141 - protein, 219 aa, Artificial Sequence
  Description of Artificial Sequence: Synthetic polypeptide
DIVMTQSPDSLAVSLGERATINCKSSQSLLNSRARKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 452 aa, Artificial Sequence; identical to SEQ ID NO: 58
  Description of Artificial Sequence: Synthetic polypeptide

SEQ ID NO: 143 - protein, 219 aa, Artificial Sequence
  Description of Artificial Sequence: Synthetic polypeptide
DIVMTQSPDSLAVSLGERATINCKSSQSLLNSRDRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - protein, 452 aa, Artificial Sequence; identical to SEQ ID NO: 58
  Description of Artificial Sequence: Synthetic polypeptide

SEQ ID NO: 145 - protein, 219 aa, Artificial Sequence
  Description of Artificial Sequence: Synthetic polypeptide
DIVMTQSPDSLAVSLGERATINCKSSQSLLNSRKRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 452 aa, Artificial Sequence; identical to SEQ ID NO: 58
  Description of Artificial Sequence: Synthetic polypeptide

SEQ ID NO: 147 - protein, 219 aa, Artificial Sequence
  Description of Artificial Sequence: Synthetic polypeptide
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 148 - protein, 452 aa, Artificial Sequence; identical to SEQ ID NO: 58
  Description of Artificial Sequence: Synthetic polypeptide

SEQ ID NO: 149 - protein, 219 aa, Artificial Sequence
  Description of Artificial Sequence: Synthetic polypeptide
DIVMTQSPDSLAVSLGERATINCKSSQSLLNSRSRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 150 - protein, 452 aa, Artificial Sequence; identical to SEQ ID NO: 58
  Description of Artificial Sequence: Synthetic polypeptide

SEQ ID NO: 151 - protein, 219 aa, Artificial Sequence
  Description of Artificial Sequence: Synthetic polypeptide
DIVMTQSPDSLAVSLGERATINCKSSQSLLNSRVRKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 152 - protein, 452 aa, Artificial Sequence; identical to SEQ ID NO: 58
  Description of Artificial Sequence: Synthetic polypeptide

SEQ ID NO: 153 - protein, 219 aa, Artificial Sequence
  Description of Artificial Sequence: Synthetic polypeptide
DIVMTQSPDSLAVSLGERATINCKSSQSLLNSRTDKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 154 - protein, 452 aa, Artificial Sequence; identical to SEQ ID NO: 58
  Description of Artificial Sequence: Synthetic polypeptide

SEQ ID NO: 155 - protein, 219 aa, Artificial Sequence
  Description of Artificial Sequence: Synthetic polypeptide
DIVMTQSPDSLAVSLGERATINCKSSQSLLNSRTKKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 156 - protein, 452 aa, Artificial Sequence; identical to SEQ ID NO: 58
  Description of Artificial Sequence: Synthetic polypeptide

SEQ ID NO: 157 - protein, 219 aa, Artificial Sequence
  Description of Artificial Sequence: Synthetic polypeptide
DIVMTQSPDSLAVSLGERATINCKSSQSLLNSRTNKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 158 - protein, 452 aa, Artificial Sequence; identical to SEQ ID NO: 58
  Description of Artificial Sequence: Synthetic polypeptide

SEQ ID NO: 159 - protein, 219 aa, Artificial Sequence
  Description of Artificial Sequence: Synthetic polypeptide
DIVMTQSPDSLAVSLGERATINCKSSQSLLNSRTQKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 452 aa, Artificial Sequence; identical to SEQ ID NO: 58
  Description of Artificial Sequence: Synthetic polypeptide

SEQ ID NO: 161 - protein, 219 aa, Artificial Sequence
  Description of Artificial Sequence: Synthetic polypeptide
DIVMTQSPDSLAVSLGERATINCKSSQSLLNSRTYKNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 452 aa, Artificial Sequence; identical to SEQ ID NO: 58
  Description of Artificial Sequence: Synthetic polypeptide

SEQ ID NO: 163 - protein, 219 aa, Artificial Sequence
  Description of Artificial Sequence: Synthetic polypeptide
DIVMTQSPDSLAVSLGERATINCKSSQSLLNSRTRENYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 164 - protein, 452 aa, Artificial Sequence; identical to SEQ ID NO: 58
  Description of Artificial Sequence: Synthetic polypeptide

SEQ ID NO: 165 - protein, 219 aa, Artificial Sequence; identical to SEQ ID NO: 61
  Description of Artificial Sequence: Synthetic polypeptide

SEQ ID NO: 166 - protein, 452 aa, Artificial Sequence; identical to SEQ ID NO: 58
  Description of Artificial Sequence: Synthetic polypeptide

SEQ ID NO: 167 - protein, 219 aa, Artificial Sequence
  Description of Artificial Sequence: Synthetic polypeptide
DIVMTQSPDSLAVSLGERATINCKSSQSLLNSRTRLNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 168 - protein, 452 aa, Artificial Sequence; identical to SEQ ID NO: 58
  Description of Artificial Sequence: Synthetic polypeptide

SEQ ID NO: 169 - protein, 219 aa, Artificial Sequence
  Description of Artificial Sequence: Synthetic polypeptide
DIVMTQSPDSLAVSLGERATINCKSSQSLLNSRTRNNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 170 - protein, 452 aa, Artificial Sequence; identical to SEQ ID NO: 58
  Description of Artificial Sequence: Synthetic polypeptide

SEQ ID NO: 171 - protein, 219 aa, Artificial Sequence
  Description of Artificial Sequence: Synthetic polypeptide
DIVMTQSPDSLAVSLGERATINCKSSQSLLNSRTRSNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 172 - protein, 452 aa, Artificial Sequence; identical to SEQ ID NO: 58
  Description of Artificial Sequence: Synthetic polypeptide

SEQ ID NO: 173 - protein, 219 aa, Artificial Sequence
  Description of Artificial Sequence: Synthetic polypeptide
DIVMTQSPDSLAVSLGERATINCKSSQSLLNSRTRYNYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 174 - protein, 452 aa, Artificial Sequence; identical to SEQ ID NO: 58
  Description of Artificial Sequence: Synthetic polypeptide

SEQ ID NO: 175 - protein, 219 aa, Artificial Sequence
  Description of Artificial Sequence: Synthetic polypeptide
DIVMTQSPDSLAVSLGERATINCKSSQSLLNSRTRKDYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 176 - protein, 452 aa, Artificial Sequence; identical to SEQ ID NO: 58
  Description of Artificial Sequence: Synthetic polypeptide

SEQ ID NO: 177 - protein, 219 aa, Artificial Sequence
  Description of Artificial Sequence: Synthetic polypeptide
DIVMTQSPDSLAVSLGERATINCKSSQSLLNSRTRKHYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 178 - protein, 452 aa, Artificial Sequence; identical to SEQ ID NO: 58
  Description of Artificial Sequence: Synthetic polypeptide

SEQ ID NO: 179 - protein, 219 aa, Artificial Sequence
  Description of Artificial Sequence: Synthetic polypeptide
DIVMTQSPDSLAVSLGERATINCKSSQSLLNSRTRKKYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 180 - protein, 452 aa, Artificial Sequence; identical to SEQ ID NO: 58
  Description of Artificial Sequence: Synthetic polypeptide

SEQ ID NO: 181 - protein, 219 aa, Artificial Sequence
  Description of Artificial Sequence: Synthetic polypeptide
DIVMTQSPDSLAVSLGERATINCKSSQSLLNSRTRKQYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 182 - protein, 452 aa, Artificial Sequence; identical to SEQ ID NO: 58
  Description of Artificial Sequence: Synthetic polypeptide

SEQ ID NO: 183 - protein, 219 aa, Artificial Sequence
  Description of Artificial Sequence: Synthetic polypeptide
DIVMTQSPDSLAVSLGERATINCKSSQSLLNSRTRKSYLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 184 - protein, 452 aa, Artificial Sequence; identical to SEQ ID NO: 58
  Description of Artificial Sequence: Synthetic polypeptide

SEQ ID NO: 185 - protein, 219 aa, Artificial Sequence
  Description of Artificial Sequence: Synthetic polypeptide
DIVMTQSPDSLAVSLGERATINCKSSQSLLNSRTRKNDLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 186 - protein, 452 aa, Artificial Sequence; identical to SEQ ID NO: 58
  Description of Artificial Sequence: Synthetic polypeptide

SEQ ID NO: 187 - protein, 219 aa, Artificial Sequence
  Description of Artificial Sequence: Synthetic polypeptide
DIVMTQSPDSLAVSLGERATINCKSSQSLLNSRTRKNFLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 188 - protein, 452 aa, Artificial Sequence; identical to SEQ ID NO: 58
  Description of Artificial Sequence: Synthetic polypeptide

SEQ ID NO: 189 - protein, 219 aa, Artificial Sequence
  Description of Artificial Sequence: Synthetic polypeptide
DIVMTQSPDSLAVSLGERATINCKSSQSLLNSRTRKNHLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 190 - protein, 452 aa, Artificial Sequence; identical to SEQ ID NO: 58
  Description of Artificial Sequence: Synthetic polypeptide

SEQ ID NO: 191 - protein, 219 aa, Artificial Sequence
  Description of Artificial Sequence: Synthetic polypeptide
DIVMTQSPDSLAVSLGERATINCKSSQSLLNSRTRKNRLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 192 - protein, 452 aa, Artificial Sequence; identical to SEQ ID NO: 58
  Description of Artificial Sequence: Synthetic polypeptide

SEQ ID NO: 193 - protein, 219 aa, Artificial Sequence
  Description of Artificial Sequence: Synthetic polypeptide
DIVMTQSPDSLAVSLGERATINCKSSQSLLNSRTRKNWLAWYQQKPDQSPKLLIYWASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 194 - protein, 452 aa, Artificial Sequence; identical to SEQ ID NO: 58
  Description of Artificial Sequence: Synthetic polypeptide

SEQ ID NO: 195 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYDASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 196 - protein, 452 aa, Artificial Sequence; identical to SEQ ID NO: 58
  Description of Artificial Sequence: Synthetic polypeptide

SEQ ID NO: 197 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYFASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 198 - protein, 452 aa, Artificial Sequence; identical to SEQ ID NO: 58
  Description of Artificial Sequence: Synthetic polypeptide

SEQ ID NO: 199 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYLASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 452 aa, Artificial Sequence; identical to SEQ ID NO: 58
  Description of Artificial Sequence: Synthetic polypeptide

SEQ ID NO: 201 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYQASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 202 - protein, 452 aa, Artificial Sequence; identical to SEQ ID NO: 58
  Description of Artificial Sequence: Synthetic polypeptide

SEQ ID NO: 203 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYRASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - protein, 452 aa, Artificial Sequence; identical to SEQ ID NO: 58
  Description of Artificial Sequence: Synthetic polypeptide

SEQ ID NO: 205 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYSASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 206 - protein, 452 aa, Artificial Sequence; identical to SEQ ID NO: 58
  Description of Artificial Sequence: Synthetic polypeptide

SEQ ID NO: 207 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYYASTRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 208 - protein, 452 aa, Artificial Sequence; identical to SEQ ID NO: 58
  Description of Artificial Sequence: Synthetic polypeptide

SEQ ID NO: 209 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASDRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 210 - protein, 452 aa, Artificial Sequence; identical to SEQ ID NO: 58
  Description of Artificial Sequence: Synthetic polypeptide

SEQ ID NO: 211 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASKRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 212 - protein, 452 aa, Artificial Sequence; identical to SEQ ID NO: 58
  Description of Artificial Sequence: Synthetic polypeptide

SEQ ID NO: 213 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASQRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 214 - protein, 452 aa, Artificial Sequence; identical to SEQ ID NO: 58
  Description of Artificial Sequence: Synthetic polypeptide

SEQ ID NO: 215 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASSRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - protein, 452 aa, Artificial Sequence; identical to SEQ ID NO: 58
  Description of Artificial Sequence: Synthetic polypeptide

SEQ ID NO: 217 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASVRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 218 - protein, 452 aa, Artificial Sequence; identical to SEQ ID NO: 58
  Description of Artificial Sequence: Synthetic polypeptide

SEQ ID NO: 219 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASYRESGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 220 - protein, 452 aa, Artificial Sequence; identical to SEQ ID NO: 58
  Description of Artificial Sequence: Synthetic polypeptide

SEQ ID NO: 221 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRASGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 452 aa, Artificial Sequence; identical to SEQ ID NO: 58
  Description of Artificial Sequence: Synthetic polypeptide

SEQ ID NO: 223 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRDSGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - protein, 452 aa, Artificial Sequence; identical to SEQ ID NO: 58
  Description of Artificial Sequence: Synthetic polypeptide

SEQ ID NO: 225 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRFSGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 226 - protein, 452 aa, Artificial Sequence; identical to SEQ ID NO: 58
  Description of Artificial Sequence: Synthetic polypeptide

SEQ ID NO: 227 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRHSGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 228 - protein, 452 aa, Artificial Sequence; identical to SEQ ID NO: 58
  Description of Artificial Sequence: Synthetic polypeptide

SEQ ID NO: 229 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRKSGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - protein, 452 aa, Artificial Sequence; identical to SEQ ID NO: 58
  Description of Artificial Sequence: Synthetic polypeptide

SEQ ID NO: 231 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRQSGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - protein, 452 aa, Artificial Sequence; identical to SEQ ID NO: 58
  Description of Artificial Sequence: Synthetic polypeptide

SEQ ID NO: 233 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQAYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 234 - protein, 452 aa, Artificial Sequence; identical to SEQ ID NO: 58
  Description of Artificial Sequence: Synthetic polypeptide

SEQ ID NO: 235 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQDYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 236 - protein, 452 aa, Artificial Sequence; identical to SEQ ID NO: 58
  Description of Artificial Sequence: Synthetic polypeptide

SEQ ID NO: 237 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQHYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 238 - protein, 452 aa, Artificial Sequence; identical to SEQ ID NO: 58
  Description of Artificial Sequence: Synthetic polypeptide

SEQ ID NO: 239 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQTYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 240 - protein, 452 aa, Artificial Sequence; identical to SEQ ID NO: 58
  Description of Artificial Sequence: Synthetic polypeptide

SEQ ID NO: 241 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQYYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - protein, 452 aa, Artificial Sequence; identical to SEQ ID NO: 58
  Description of Artificial Sequence: Synthetic polypeptide

SEQ ID NO: 243 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSEYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 244 - protein, 452 aa, Artificial Sequence; identical to SEQ ID NO: 58
  Description of Artificial Sequence: Synthetic polypeptide

SEQ ID NO: 245 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSFYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 246 - protein, 452 aa, Artificial Sequence; identical to SEQ ID NO: 58
  Description of Artificial Sequence: Synthetic polypeptide

SEQ ID NO: 247 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSHYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - protein, 452 aa, Artificial Sequence; identical to SEQ ID NO: 58
  Description of Artificial Sequence: Synthetic polypeptide

SEQ ID NO: 249 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSLYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 250 - protein, 452 aa, Artificial Sequence; identical to SEQ ID NO: 58
  Description of Artificial Sequence: Synthetic polypeptide

SEQ ID NO: 251 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSNYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 252 - protein, 452 aa, Artificial Sequence; identical to SEQ ID NO: 58
  Description of Artificial Sequence: Synthetic polypeptide

SEQ ID NO: 253 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSRYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 254 - protein, 452 aa, Artificial Sequence; identical to SEQ ID NO: 58
  Description of Artificial Sequence: Synthetic polypeptide

SEQ ID NO: 255 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSTYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 256 - protein, 452 aa, Artificial Sequence; identical to SEQ ID NO: 58
  Description of Artificial Sequence: Synthetic polypeptide

SEQ ID NO: 257 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYELWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 258 - protein, 452 aa, Artificial Sequence; identical to SEQ ID NO: 58
  Description of Artificial Sequence: Synthetic polypeptide

SEQ ID NO: 259 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYFLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 260 - protein, 452 aa, Artificial Sequence; identical to SEQ ID NO: 58
  Description of Artificial Sequence: Synthetic polypeptide

SEQ ID NO: 261 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYHLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 452 aa, Artificial Sequence; identical to SEQ ID NO: 58
  Description of Artificial Sequence: Synthetic polypeptide

SEQ ID NO: 263 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYKLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 264 - protein, 452 aa, Artificial Sequence; identical to SEQ ID NO: 58
  Description of Artificial Sequence: Synthetic polypeptide

SEQ ID NO: 265 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYNLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 266 - protein, 452 aa, Artificial Sequence; identical to SEQ ID NO: 58
  Description of Artificial Sequence: Synthetic polypeptide

SEQ ID NO: 267 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYQLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 268 - protein, 452 aa, Artificial Sequence; identical to SEQ ID NO: 58
  Description of Artificial Sequence: Synthetic polypeptide

SEQ ID NO: 269 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYSLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 270 - protein, 452 aa, Artificial Sequence; identical to SEQ ID NO: 58
  Description of Artificial Sequence: Synthetic polypeptide

SEQ ID NO: 271 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYDWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 272 - protein, 452 aa, Artificial Sequence; identical to SEQ ID NO: 58
  Description of Artificial Sequence: Synthetic polypeptide

SEQ ID NO: 273 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYIWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 274 - protein, 452 aa, Artificial Sequence; identical to SEQ ID NO: 58
  Description of Artificial Sequence: Synthetic polypeptide

SEQ ID NO: 275 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYKWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 276 - protein, 452 aa, Artificial Sequence; identical to SEQ ID NO: 58
  Description of Artificial Sequence: Synthetic polypeptide

SEQ ID NO: 277 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYSWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 278 - protein, 452 aa, Artificial Sequence; identical to SEQ ID NO: 58
  Description of Artificial Sequence: Synthetic polypeptide

SEQ ID NO: 279 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYTWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 280 - protein, 452 aa, Artificial Sequence; identical to SEQ ID NO: 58
  Description of Artificial Sequence: Synthetic polypeptide

SEQ ID NO: 281 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYYWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 452 aa, Artificial Sequence; identical to SEQ ID NO: 58
  Description of Artificial Sequence: Synthetic polypeptide

SEQ ID NO: 283 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 452 aa, Artificial Sequence; identical to SEQ ID NO: 58
  Description of Artificial Sequence: Synthetic polypeptide

SEQ ID NO: 285 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 286 - protein, 452 aa, Artificial Sequence; identical to SEQ ID NO: 58
  Description of Artificial Sequence: Synthetic polypeptide

SEQ ID NO: 287 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 288 - protein, 452 aa, Artificial Sequence; identical to SEQ ID NO: 58
  Description of Artificial Sequence: Synthetic polypeptide

SEQ ID NO: 289 - protein, 219 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 290 - protein, 452 aa, Artificial Sequence
  Description of Artificial Sequence: Synthetic polypeptide
EVQLVESGGGLVQPGGSLRLSCAASGFTFDDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 219 aa, Artificial Sequence; identical to SEQ ID NO: 61
  Description of Artificial Sequence: Synthetic polypeptide

SEQ ID NO: 292 - protein, 452 aa, Artificial Sequence
  Description of Artificial Sequence: Synthetic polypeptide
EVQLVESGGGLVQPGGSLRLSCAASGFTFHDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 219 aa, Artificial Sequence; identical to SEQ ID NO: 61
  Description of Artificial Sequence: Synthetic polypeptide

SEQ ID NO: 294 - protein, 452 aa, Artificial Sequence
  Description of Artificial Sequence: Synthetic polypeptide
EVQLVESGGGLVQPGGSLRLSCAASGFTFKDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 219 aa, Artificial Sequence; identical to SEQ ID NO: 61
  Description of Artificial Sequence: Synthetic polypeptide

SEQ ID NO: 296 - protein, 452 aa, Artificial Sequence
  Description of Artificial Sequence: Synthetic polypeptide
EVQLVESGGGLVQPGGSLRLSCAASGFTFQDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 219 aa, Artificial Sequence; identical to SEQ ID NO: 61
  Description of Artificial Sequence: Synthetic polypeptide

SEQ ID NO: 298 - protein, 452 aa, Artificial Sequence
  Description of Artificial Sequence: Synthetic polypeptide
EVQLVESGGGLVQPGGSLRLSCAASGFTFTDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 219 aa, Artificial Sequence; identical to SEQ ID NO: 61
  Description of Artificial Sequence: Synthetic polypeptide

SEQ ID NO: 300 - protein, 452 aa, Artificial Sequence
  Description of Artificial Sequence: Synthetic polypeptide
EVQLVESGGGLVQPGGSLRLSCAASGFTFSEYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 219 aa, Artificial Sequence; identical to SEQ ID NO: 61
  Description of Artificial Sequence: Synthetic polypeptide

SEQ ID NO: 302 - protein, 452 aa, Artificial Sequence
  Description of Artificial Sequence: Synthetic polypeptide
EVQLVESGGGLVQPGGSLRLSCAASGFTFSHYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 219 aa, Artificial Sequence; identical to SEQ ID NO: 61
  Description of Artificial Sequence: Synthetic polypeptide

SEQ ID NO: 304 - protein, 452 aa, Artificial Sequence
  Description of Artificial Sequence: Synthetic polypeptide
EVQLVESGGGLVQPGGSLRLSCAASGFTFSLYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 219 aa, Artificial Sequence; identical to SEQ ID NO: 61
  Description of Artificial Sequence: Synthetic polypeptide

SEQ ID NO: 306 - protein, 452 aa, Artificial Sequence
  Description of Artificial Sequence: Synthetic polypeptide
EVQLVESGGGLVQPGGSLRLSCAASGFTFSNYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 219 aa, Artificial Sequence; identical to SEQ ID NO: 61
  Description of Artificial Sequence: Synthetic polypeptide

SEQ ID NO: 308 - protein, 452 aa, Artificial Sequence
  Description of Artificial Sequence: Synthetic polypeptide
EVQLVESGGGLVQPGGSLRLSCAASGFTFSRYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 309 - protein, 219 aa, Artificial Sequence; identical to SEQ ID NO: 61
  Description of Artificial Sequence: Synthetic polypeptide

SEQ ID NO: 310 - protein, 452 aa, Artificial Sequence
  Description of Artificial Sequence: Synthetic polypeptide
EVQLVESGGGLVQPGGSLRLSCAASGFTFSSYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 219 aa, Artificial Sequence; identical to SEQ ID NO: 61
  Description of Artificial Sequence: Synthetic polypeptide

SEQ ID NO: 312 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 219 aa, Artificial Sequence; identical to SEQ ID NO: 61
  Description of Artificial Sequence: Synthetic polypeptide

SEQ ID NO: 314 - protein, 452 aa, Artificial Sequence
  Description of Artificial Sequence: Synthetic polypeptide
EVQLVESGGGLVQPGGSLRLSCAASGFTFSDDGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - protein, 219 aa, Artificial Sequence; identical to SEQ ID NO: 61
  Description of Artificial Sequence: Synthetic polypeptide

SEQ ID NO: 316 - protein, 452 aa, Artificial Sequence
  Description of Artificial Sequence: Synthetic polypeptide
EVQLVESGGGLVQPGGSLRLSCAASGFTFSDFGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 317 - protein, 219 aa, Artificial Sequence; identical to SEQ ID NO: 61
  Description of Artificial Sequence: Synthetic polypeptide

SEQ ID NO: 318 - protein, 452 aa, Artificial Sequence
  Description of Artificial Sequence: Synthetic polypeptide
EVQLVESGGGLVQPGGSLRLSCAASGFTFSDKGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 319 - protein, 219 aa, Artificial Sequence; identical to SEQ ID NO: 61
  Description of Artificial Sequence: Synthetic polypeptide

SEQ ID NO: 320 - protein, 452 aa, Artificial Sequence
  Description of Artificial Sequence: Synthetic polypeptide
EVQLVESGGGLVQPGGSLRLSCAASGFTFSDLGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 219 aa, Artificial Sequence; identical to SEQ ID NO: 61
  Description of Artificial Sequence: Synthetic polypeptide

SEQ ID NO: 322 - protein, 452 aa, Artificial Sequence
  Description of Artificial Sequence: Synthetic polypeptide
EVQLVESGGGLVQPGGSLRLSCAASGFTFSDNGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 323 - protein, 219 aa, Artificial Sequence; identical to SEQ ID NO: 61
  Description of Artificial Sequence: Synthetic polypeptide

SEQ ID NO: 324 - protein, 452 aa, Artificial Sequence
  Description of Artificial Sequence: Synthetic polypeptide
EVQLVESGGGLVQPGGSLRLSCAASGFTFSDQGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 325 - protein, 219 aa, Artificial Sequence; identical to SEQ ID NO: 61
  Description of Artificial Sequence: Synthetic polypeptide

SEQ ID NO: 326 - protein, 452 aa, Artificial Sequence
  Description of Artificial Sequence: Synthetic polypeptide
EVQLVESGGGLVQPGGSLRLSCAASGFTFSDWGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - protein, 219 aa, Artificial Sequence; identical to SEQ ID NO: 61
  Description of Artificial Sequence: Synthetic polypeptide

SEQ ID NO: 328 - protein, 452 aa, Artificial Sequence
  Description of Artificial Sequence: Synthetic polypeptide
EVQLVESGGGLVQPGGSLRLSCAASGFTFSDYGMHWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 329 - protein, 219 aa, Artificial Sequence; identical to SEQ ID NO: 61
  Description of Artificial Sequence: Synthetic polypeptide

SEQ ID NO: 330 - protein, 452 aa, Artificial Sequence
  Description of Artificial Sequence: Synthetic polypeptide
EVQLVESGGGLVQPGGSLRLSCAASGFTFSDYGMNWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 219 aa, Artificial Sequence; identical to SEQ ID NO: 61
  Description of Artificial Sequence: Synthetic polypeptide

SEQ ID NO: 332 - protein, 452 aa, Artificial Sequence
  Description of Artificial Sequence: Synthetic polypeptide
EVQLVESGGGLVQPGGSLRLSCAASGFTFSDYGMSWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - protein, 219 aa, Artificial Sequence; identical to SEQ ID NO: 61
  Description of Artificial Sequence: Synthetic polypeptide

SEQ ID NO: 334 - protein, 452 aa, Artificial Sequence
  Description of Artificial Sequence: Synthetic polypeptide
EVQLVESGGGLVQPGGSLRLSCAASGFTFSDYGMAWVRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 335 - protein, 219 aa, Artificial Sequence; identical to SEQ ID NO: 61
  Description of Artificial Sequence: Synthetic polypeptide

SEQ ID NO: 336 - protein, 452 aa, Artificial Sequence
  Description of Artificial Sequence: Synthetic polypeptide
EVQLVESGGGLVQPGGSLRLSCAASGFTFSDYGMAWFRQAPGKGLEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 337 - protein, 219 aa, Artificial Sequence; identical to SEQ ID NO: 61
  Description of Artificial Sequence: Synthetic polypeptide

SEQ ID NO: 338 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFIANLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 339 - protein, 219 aa, Artificial Sequence; identical to SEQ ID NO: 61
  Description of Artificial Sequence: Synthetic polypeptide

SEQ ID NO: 340 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFINNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 219 aa, Artificial Sequence; identical to SEQ ID NO: 61
  Description of Artificial Sequence: Synthetic polypeptide

SEQ ID NO: 342 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFITNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 343 - protein, 219 aa, Artificial Sequence; identical to SEQ ID NO: 61
  Description of Artificial Sequence: Synthetic polypeptide

SEQ ID NO: 344 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFIYNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 345 - protein, 219 aa, Artificial Sequence; identical to SEQ ID NO: 61
  Description of Artificial Sequence: Synthetic polypeptide

SEQ ID NO: 346 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISDLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 347 - protein, 219 aa, Artificial Sequence; identical to SEQ ID NO: 61
  Description of Artificial Sequence: Synthetic polypeptide

SEQ ID NO: 348 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISELAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 349 - protein, 219 aa, Artificial Sequence; identical to SEQ ID NO: 61
  Description of Artificial Sequence: Synthetic polypeptide

SEQ ID NO: 350 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISHLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 219 aa, Artificial Sequence; identical to SEQ ID NO: 61
  Description of Artificial Sequence: Synthetic polypeptide

SEQ ID NO: 352 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISLLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - protein, 219 aa, Artificial Sequence; identical to SEQ ID NO: 61
  Description of Artificial Sequence: Synthetic polypeptide

SEQ ID NO: 354 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISQLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 355 - protein, 219 aa, Artificial Sequence; identical to SEQ ID NO: 61
  Description of Artificial Sequence: Synthetic polypeptide

SEQ ID NO: 356 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISRLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 357 - protein, 219 aa, Artificial Sequence; identical to SEQ ID NO: 61
  Description of Artificial Sequence: Synthetic polypeptide

SEQ ID NO: 358 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISSLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - protein, 219 aa, Artificial Sequence; identical to SEQ ID NO: 61
  Description of Artificial Sequence: Synthetic polypeptide

SEQ ID NO: 360 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNDAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 219 aa, Artificial Sequence; identical to SEQ ID NO: 61
  Description of Artificial Sequence: Synthetic polypeptide

SEQ ID NO: 362 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNFAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 363 - protein, 219 aa, Artificial Sequence; identical to SEQ ID NO: 61
  Description of Artificial Sequence: Synthetic polypeptide

SEQ ID NO: 364 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNIAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 365 - protein, 219 aa, Artificial Sequence; identical to SEQ ID NO: 61
  Description of Artificial Sequence: Synthetic polypeptide

SEQ ID NO: 366 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNKAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 367 - protein, 219 aa, Artificial Sequence; identical to SEQ ID NO: 61
  Description of Artificial Sequence: Synthetic polypeptide

SEQ ID NO: 368 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNSAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - protein, 219 aa, Artificial Sequence; identical to SEQ ID NO: 61
  Description of Artificial Sequence: Synthetic polypeptide

SEQ ID NO: 370 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNVAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 219 aa, Artificial Sequence; identical to SEQ ID NO: 61
  Description of Artificial Sequence: Synthetic polypeptide

SEQ ID NO: 372 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 373 - protein, 219 aa, Artificial Sequence; identical to SEQ ID NO: 61
  Description of Artificial Sequence: Synthetic polypeptide

SEQ ID NO: 374 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLADSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 375 - protein, 219 aa, Artificial Sequence; identical to SEQ ID NO: 61
  Description of Artificial Sequence: Synthetic polypeptide

SEQ ID NO: 376 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAFSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 377 - protein, 219 aa, Artificial Sequence; identical to SEQ ID NO: 61
  Description of Artificial Sequence: Synthetic polypeptide

SEQ ID NO: 378 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAHSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 379 - protein, 219 aa, Artificial Sequence; identical to SEQ ID NO: 61
  Description of Artificial Sequence: Synthetic polypeptide

SEQ ID NO: 380 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAKSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 381 - protein, 219 aa, Artificial Sequence; identical to SEQ ID NO: 61
  Description of Artificial Sequence: Synthetic polypeptide

SEQ ID NO: 382 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLANSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - protein, 219 aa, Artificial Sequence; identical to SEQ ID NO: 61
  Description of Artificial Sequence: Synthetic polypeptide

SEQ ID NO: 384 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAQSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 385 - protein, 219 aa, Artificial Sequence; identical to SEQ ID NO: 61
  Description of Artificial Sequence: Synthetic polypeptide

SEQ ID NO: 386 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYAIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 387 - protein, 219 aa, Artificial Sequence; identical to SEQ ID NO: 61
  Description of Artificial Sequence: Synthetic polypeptide

SEQ ID NO: 388 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYDIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 219 aa, Artificial Sequence; identical to SEQ ID NO: 61
  Description of Artificial Sequence: Synthetic polypeptide

SEQ ID NO: 390 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYHIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 219 aa, Artificial Sequence; identical to SEQ ID NO: 61
  Description of Artificial Sequence: Synthetic polypeptide

SEQ ID NO: 392 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYKIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 393 - protein, 219 aa, Artificial Sequence; identical to SEQ ID NO: 61
  Description of Artificial Sequence: Synthetic polypeptide

SEQ ID NO: 394 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYQIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 395 - protein, 219 aa, Artificial Sequence; identical to SEQ ID NO: 61
  Description of Artificial Sequence: Synthetic polypeptide

SEQ ID NO: 396 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYTIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 397 - protein, 219 aa, Artificial Sequence; identical to SEQ ID NO: 61
  Description of Artificial Sequence: Synthetic polypeptide

SEQ ID NO: 398 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIDYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - protein, 219 aa, Artificial Sequence; identical to SEQ ID NO: 61
  Description of Artificial Sequence: Synthetic polypeptide

SEQ ID NO: 400 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIFYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 219 aa, Artificial Sequence; identical to SEQ ID NO: 61
  Description of Artificial Sequence: Synthetic polypeptide

SEQ ID NO: 402 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIHYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 219 aa, Artificial Sequence; identical to SEQ ID NO: 61
  Description of Artificial Sequence: Synthetic polypeptide

SEQ ID NO: 404 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSILYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 219 aa, Artificial Sequence; identical to SEQ ID NO: 61
  Description of Artificial Sequence: Synthetic polypeptide

SEQ ID NO: 406 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIRYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 407 - protein, 219 aa, Artificial Sequence; identical to SEQ ID NO: 61
  Description of Artificial Sequence: Synthetic polypeptide

SEQ ID NO: 408 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIVYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 409 - protein, 219 aa, Artificial Sequence; identical to SEQ ID NO: 61
  Description of Artificial Sequence: Synthetic polypeptide

SEQ ID NO: 410 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARDPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - protein, 219 aa, Artificial Sequence; identical to SEQ ID NO: 61
  Description of Artificial Sequence: Synthetic polypeptide

SEQ ID NO: 412 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARKPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 219 aa, Artificial Sequence; identical to SEQ ID NO: 61
  Description of Artificial Sequence: Synthetic polypeptide

SEQ ID NO: 414 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARSPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 219 aa, Artificial Sequence; identical to SEQ ID NO: 61
  Description of Artificial Sequence: Synthetic polypeptide

SEQ ID NO: 416 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARTPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 219 aa, Artificial Sequence; identical to SEQ ID NO: 61
  Description of Artificial Sequence: Synthetic polypeptide

SEQ ID NO: 418 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARVPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - protein, 219 aa, Artificial Sequence; identical to SEQ ID NO: 61
  Description of Artificial Sequence: Synthetic polypeptide

SEQ ID NO: 420 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAAYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - protein, 219 aa, Artificial Sequence; identical to SEQ ID NO: 61
  Description of Artificial Sequence: Synthetic polypeptide

SEQ ID NO: 422 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAGYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 423 - protein, 219 aa, Artificial Sequence; identical to SEQ ID NO: 61
  Description of Artificial Sequence: Synthetic polypeptide

SEQ ID NO: 424 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARASYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - protein, 219 aa, Artificial Sequence; identical to SEQ ID NO: 61
  Description of Artificial Sequence: Synthetic polypeptide

SEQ ID NO: 426 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAVYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 427 - protein, 219 aa, Artificial Sequence; identical to SEQ ID NO: 61
  Description of Artificial Sequence: Synthetic polypeptide

SEQ ID NO: 428 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPDDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - protein, 219 aa, Artificial Sequence; identical to SEQ ID NO: 61
  Description of Artificial Sequence: Synthetic polypeptide

SEQ ID NO: 430 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPFDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 219 aa, Artificial Sequence; identical to SEQ ID NO: 61
  Description of Artificial Sequence: Synthetic polypeptide

SEQ ID NO: 432 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPHDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 433 - protein, 219 aa, Artificial Sequence; identical to SEQ ID NO: 61
  Description of Artificial Sequence: Synthetic polypeptide

SEQ ID NO: 434 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPKDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 435 - protein, 219 aa, Artificial Sequence; identical to SEQ ID NO: 61
  Description of Artificial Sequence: Synthetic polypeptide

SEQ ID NO: 436 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPLDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 437 - protein, 219 aa, Artificial Sequence; identical to SEQ ID NO: 61
  Description of Artificial Sequence: Synthetic polypeptide

SEQ ID NO: 438 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPQDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 439 - protein, 219 aa, Artificial Sequence; identical to SEQ ID NO: 61
  Description of Artificial Sequence: Synthetic polypeptide

SEQ ID NO: 440 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPWDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 441 - protein, 219 aa, Artificial Sequence; identical to SEQ ID NO: 61
  Description of Artificial Sequence: Synthetic polypeptide

SEQ ID NO: 442 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYEYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 443 - protein, 219 aa, Artificial Sequence; identical to SEQ ID NO: 61
  Description of Artificial Sequence: Synthetic polypeptide

SEQ ID NO: 444 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYHYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 445 - protein, 219 aa, Artificial Sequence; identical to SEQ ID NO: 61
  Description of Artificial Sequence: Synthetic polypeptide

SEQ ID NO: 446 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYLYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 447 - protein, 219 aa, Artificial Sequence; identical to SEQ ID NO: 61
  Description of Artificial Sequence: Synthetic polypeptide

SEQ ID NO: 448 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYNYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 449 - protein, 219 aa, Artificial Sequence; identical to SEQ ID NO: 61
  Description of Artificial Sequence: Synthetic polypeptide

SEQ ID NO: 450 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYQYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 451 - protein, 219 aa, Artificial Sequence; identical to SEQ ID NO: 61
  Description of Artificial Sequence: Synthetic polypeptide

SEQ ID NO: 452 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYRYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 453 - protein, 219 aa, Artificial Sequence; identical to SEQ ID NO: 61
  Description of Artificial Sequence: Synthetic polypeptide

SEQ ID NO: 454 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYSYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - protein, 219 aa, Artificial Sequence; identical to SEQ ID NO: 61
  Description of Artificial Sequence: Synthetic polypeptide

SEQ ID NO: 456 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDDDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 457 - protein, 219 aa, Artificial Sequence; identical to SEQ ID NO: 61
  Description of Artificial Sequence: Synthetic polypeptide

SEQ ID NO: 458 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDFDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 459 - protein, 219 aa, Artificial Sequence; identical to SEQ ID NO: 61
  Description of Artificial Sequence: Synthetic polypeptide

SEQ ID NO: 460 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDHDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 461 - protein, 219 aa, Artificial Sequence; identical to SEQ ID NO: 61
  Description of Artificial Sequence: Synthetic polypeptide

SEQ ID NO: 462 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDKDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 463 - protein, 219 aa, Artificial Sequence; identical to SEQ ID NO: 61
  Description of Artificial Sequence: Synthetic polypeptide

SEQ ID NO: 464 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDLDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 465 - protein, 219 aa, Artificial Sequence; identical to SEQ ID NO: 61
  Description of Artificial Sequence: Synthetic polypeptide

SEQ ID NO: 466 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDQDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 467 - protein, 219 aa, Artificial Sequence; identical to SEQ ID NO: 61
  Description of Artificial Sequence: Synthetic polypeptide

SEQ ID NO: 468 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDWDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 469 - protein, 219 aa, Artificial Sequence; identical to SEQ ID NO: 61
  Description of Artificial Sequence: Synthetic polypeptide

SEQ ID NO: 470 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYESFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 471 - protein, 219 aa, Artificial Sequence; identical to SEQ ID NO: 61
  Description of Artificial Sequence: Synthetic polypeptide

SEQ ID NO: 472 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYLSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - protein, 219 aa, Artificial Sequence; identical to SEQ ID NO: 61
  Description of Artificial Sequence: Synthetic polypeptide

SEQ ID NO: 474 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYNSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - protein, 219 aa, Artificial Sequence; identical to SEQ ID NO: 61
  Description of Artificial Sequence: Synthetic polypeptide

SEQ ID NO: 476 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYQSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - protein, 219 aa, Artificial Sequence; identical to SEQ ID NO: 61
  Description of Artificial Sequence: Synthetic polypeptide

SEQ ID NO: 478 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYSSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 219 aa, Artificial Sequence; identical to SEQ ID NO: 61
  Description of Artificial Sequence: Synthetic polypeptide

SEQ ID NO: 480 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDAFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 219 aa, Artificial Sequence; identical to SEQ ID NO: 61
  Description of Artificial Sequence: Synthetic polypeptide

SEQ ID NO: 482 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDDFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - protein, 219 aa, Artificial Sequence; identical to SEQ ID NO: 61
  Description of Artificial Sequence: Synthetic polypeptide

SEQ ID NO: 484 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDHFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 219 aa, Artificial Sequence; identical to SEQ ID NO: 61
  Description of Artificial Sequence: Synthetic polypeptide

SEQ ID NO: 486 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDKFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - protein, 219 aa, Artificial Sequence; identical to SEQ ID NO: 61
  Description of Artificial Sequence: Synthetic polypeptide

SEQ ID NO: 488 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDQFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 219 aa, Artificial Sequence; identical to SEQ ID NO: 61
  Description of Artificial Sequence: Synthetic polypeptide

SEQ ID NO: 490 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDTFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 491 - protein, 219 aa, Artificial Sequence; identical to SEQ ID NO: 61
  Description of Artificial Sequence: Synthetic polypeptide

SEQ ID NO: 492 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSDYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - protein, 219 aa, Artificial Sequence; identical to SEQ ID NO: 61
  Description of Artificial Sequence: Synthetic polypeptide

SEQ ID NO: 494 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSHYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 495 - protein, 219 aa, Artificial Sequence; identical to SEQ ID NO: 61
  Description of Artificial Sequence: Synthetic polypeptide

SEQ ID NO: 496 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSKYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - protein, 219 aa, Artificial Sequence; identical to SEQ ID NO: 61
  Description of Artificial Sequence: Synthetic polypeptide

SEQ ID NO: 498 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSLYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - protein, 219 aa, Artificial Sequence; identical to SEQ ID NO: 61
  Description of Artificial Sequence: Synthetic polypeptide

SEQ ID NO: 500 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSYYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 219 aa, Artificial Sequence; identical to SEQ ID NO: 61
  Description of Artificial Sequence: Synthetic polypeptide

SEQ ID NO: 502 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 503 - protein, 219 aa, Artificial Sequence; identical to SEQ ID NO: 61
  Description of Artificial Sequence: Synthetic polypeptide

SEQ ID NO: 504 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFFPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 505 - protein, 219 aa, Artificial Sequence; identical to SEQ ID NO: 61
  Description of Artificial Sequence: Synthetic polypeptide

SEQ ID NO: 506 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFHPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 507 - protein, 219 aa, Artificial Sequence; identical to SEQ ID NO: 61
  Description of Artificial Sequence: Synthetic polypeptide

SEQ ID NO: 508 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFRPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 509 - protein, 219 aa, Artificial Sequence; identical to SEQ ID NO: 61
  Description of Artificial Sequence: Synthetic polypeptide

SEQ ID NO: 510 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFVPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 511 - protein, 219 aa, Artificial Sequence; identical to SEQ ID NO: 61
  Description of Artificial Sequence: Synthetic polypeptide

SEQ ID NO: 512 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFWPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 513 - protein, 219 aa, Artificial Sequence; identical to SEQ ID NO: 61
  Description of Artificial Sequence: Synthetic polypeptide

SEQ ID NO: 514 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 515 - protein, 219 aa, Artificial Sequence; identical to SEQ ID NO: 61
  Description of Artificial Sequence: Synthetic polypeptide

SEQ ID NO: 516 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 517 - protein, 219 aa, Artificial Sequence; identical to SEQ ID NO: 61
  Description of Artificial Sequence: Synthetic polypeptide

SEQ ID NO: 518 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYYMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 519 - protein, 219 aa, Artificial Sequence; identical to SEQ ID NO: 61
  Description of Artificial Sequence: Synthetic polypeptide

SEQ ID NO: 520 - protein, 452 aa, Artificial Sequence; identical to SEQ ID NO: 312
  Description of Artificial Sequence: Synthetic polypeptide

SEQ ID NO: 521 - protein, 219 aa, Artificial Sequence; identical to SEQ ID NO: 147
  Description of Artificial Sequence: Synthetic polypeptide

SEQ ID NO: 522 - protein, 452 aa, Artificial Sequence; identical to SEQ ID NO: 312
  Description of Artificial Sequence: Synthetic polypeptide

SEQ ID NO: 523 - protein, 219 aa, Artificial Sequence; identical to SEQ ID NO: 207
  Description of Artificial Sequence: Synthetic polypeptide

SEQ ID NO: 524 - protein, 452 aa, Artificial Sequence; identical to SEQ ID NO: 312
  Description of Artificial Sequence: Synthetic polypeptide

SEQ ID NO: 525 - protein, 219 aa, Artificial Sequence; identical to SEQ ID NO: 221
  Description of Artificial Sequence: Synthetic polypeptide

SEQ ID NO: 526 - protein, 452 aa, Artificial Sequence; identical to SEQ ID NO: 502
  Description of Artificial Sequence: Synthetic polypeptide

SEQ ID NO: 527 - protein, 219 aa, Artificial Sequence; identical to SEQ ID NO: 147
  Description of Artificial Sequence: Synthetic polypeptide

SEQ ID NO: 528 - protein, 452 aa, Artificial Sequence; identical to SEQ ID NO: 502
  Description of Artificial Sequence: Synthetic polypeptide

SEQ ID NO: 529 - protein, 219 aa, Artificial Sequence; identical to SEQ ID NO: 207
  Description of Artificial Sequence: Synthetic polypeptide

SEQ ID NO: 530 - protein, 452 aa, Artificial Sequence; identical to SEQ ID NO: 502
  Description of Artificial Sequence: Synthetic polypeptide

SEQ ID NO: 531 - protein, 219 aa, Artificial Sequence; identical to SEQ ID NO: 221
  Description of Artificial Sequence: Synthetic polypeptide

SEQ ID NO: 532 - protein, 452 aa, Artificial Sequence; identical to SEQ ID NO: 514
  Description of Artificial Sequence: Synthetic polypeptide

SEQ ID NO: 533 - protein, 219 aa, Artificial Sequence; identical to SEQ ID NO: 147
  Description of Artificial Sequence: Synthetic polypeptide

SEQ ID NO: 534 - protein, 452 aa, Artificial Sequence; identical to SEQ ID NO: 514
  Description of Artificial Sequence: Synthetic polypeptide

SEQ ID NO: 535 - protein, 219 aa, Artificial Sequence; identical to SEQ ID NO: 207
  Description of Artificial Sequence: Synthetic polypeptide

SEQ ID NO: 536 - protein, 452 aa, Artificial Sequence; identical to SEQ ID NO: 514
  Description of Artificial Sequence: Synthetic polypeptide

SEQ ID NO: 537 - protein, 219 aa, Artificial Sequence; identical to SEQ ID NO: 221
  Description of Artificial Sequence: Synthetic polypeptide

SEQ ID NO: 538 - protein, 452 aa, Artificial Sequence; identical to SEQ ID NO: 58
  Description of Artificial Sequence: Synthetic polypeptide

SEQ ID NO: 539 - protein, 219 aa, Artificial Sequence
  Description of Artificial Sequence: Synthetic polypeptide
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 540 - protein, 452 aa, Artificial Sequence; identical to SEQ ID NO: 58
  Description of Artificial Sequence: Synthetic polypeptide

SEQ ID NO: 541 - protein, 219 aa, Artificial Sequence; identical to SEQ ID NO: 539
  Description of Artificial Sequence: Synthetic polypeptide

SEQ ID NO: 542 - protein, 452 aa, Artificial Sequence; identical to SEQ ID NO: 58
  Description of Artificial Sequence: Synthetic polypeptide

SEQ ID NO: 543 - protein, 219 aa, Artificial Sequence; identical to SEQ ID NO: 539
  Description of Artificial Sequence: Synthetic polypeptide

SEQ ID NO: 544 - protein, 452 aa, Artificial Sequence; identical to SEQ ID NO: 58
  Description of Artificial Sequence: Synthetic polypeptide

SEQ ID NO: 545 - protein, 219 aa, Artificial Sequence; identical to SEQ ID NO: 539
  Description of Artificial Sequence: Synthetic polypeptide

SEQ ID NO: 546 - protein, 452 aa, Artificial Sequence; identical to SEQ ID NO: 58
  Description of Artificial Sequence: Synthetic polypeptide

SEQ ID NO: 547 - protein, 219 aa, Artificial Sequence; identical to SEQ ID NO: 539
  Description of Artificial Sequence: Synthetic polypeptide

SEQ ID NO: 548 - protein, 452 aa, Artificial Sequence; identical to SEQ ID NO: 58
  Description of Artificial Sequence: Synthetic polypeptide

SEQ ID NO: 549 - protein, 219 aa, Artificial Sequence; identical to SEQ ID NO: 539
  Description of Artificial Sequence: Synthetic polypeptide

SEQ ID NO: 550 - protein, 452 aa, Artificial Sequence; identical to SEQ ID NO: 58
  Description of Artificial Sequence: Synthetic polypeptide

SEQ ID NO: 551 - protein, 219 aa, Artificial Sequence; identical to SEQ ID NO: 539
  Description of Artificial Sequence: Synthetic polypeptide

SEQ ID NO: 552 - protein, 452 aa, Artificial Sequence; identical to SEQ ID NO: 58
  Description of Artificial Sequence: Synthetic polypeptide

SEQ ID NO: 553 - protein, 219 aa, Artificial Sequence; identical to SEQ ID NO: 539
  Description of Artificial Sequence: Synthetic polypeptide

SEQ ID NO: 554 - protein, 452 aa, Artificial Sequence; identical to SEQ ID NO: 58
  Description of Artificial Sequence: Synthetic polypeptide

SEQ ID NO: 555 - protein, 219 aa, Artificial Sequence; identical to SEQ ID NO: 539
  Description of Artificial Sequence: Synthetic polypeptide

SEQ ID NO: 556 - protein, 452 aa, Artificial Sequence; identical to SEQ ID NO: 58
  Description of Artificial Sequence: Synthetic polypeptide

SEQ ID NO: 557 - protein, 219 aa, Artificial Sequence; identical to SEQ ID NO: 539
  Description of Artificial Sequence: Synthetic polypeptide

SEQ ID NO: 558 - protein, 452 aa, Artificial Sequence; identical to SEQ ID NO: 58
  Description of Artificial Sequence: Synthetic polypeptide

SEQ ID NO: 559 - protein, 219 aa, Artificial Sequence; identical to SEQ ID NO: 539
  Description of Artificial Sequence: Synthetic polypeptide

SEQ ID NO: 560 - protein, 452 aa, Artificial Sequence; identical to SEQ ID NO: 58
  Description of Artificial Sequence: Synthetic polypeptide

SEQ ID NO: 561 - protein, 219 aa, Artificial Sequence; identical to SEQ ID NO: 539
  Description of Artificial Sequence: Synthetic polypeptide

SEQ ID NO: 562 - protein, 452 aa, Artificial Sequence; identical to SEQ ID NO: 58
  Description of Artificial Sequence: Synthetic polypeptide

SEQ ID NO: 563 - protein, 219 aa, Artificial Sequence; identical to SEQ ID NO: 539
  Description of Artificial Sequence: Synthetic polypeptide

SEQ ID NO: 564 - protein, 452 aa, Artificial Sequence; identical to SEQ ID NO: 58
  Description of Artificial Sequence: Synthetic polypeptide

SEQ ID NO: 565 - protein, 219 aa, Artificial Sequence; identical to SEQ ID NO: 539
  Description of Artificial Sequence: Synthetic polypeptide

SEQ ID NO: 566 - protein, 452 aa, Artificial Sequence; identical to SEQ ID NO: 58
  Description of Artificial Sequence: Synthetic polypeptide

SEQ ID NO: 567 - protein, 219 aa, Artificial Sequence; identical to SEQ ID NO: 539
  Description of Artificial Sequence: Synthetic polypeptide

SEQ ID NO: 568 - protein, 452 aa, Artificial Sequence; identical to SEQ ID NO: 58
  Description of Artificial Sequence: Synthetic polypeptide

SEQ ID NO: 569 - protein, 219 aa, Artificial Sequence; identical to SEQ ID NO: 539
  Description of Artificial Sequence: Synthetic polypeptide

SEQ ID NO: 570 - protein, 452 aa, Artificial Sequence; identical to SEQ ID NO: 58
  Description of Artificial Sequence: Synthetic polypeptide

SEQ ID NO: 571 - protein, 219 aa, Artificial Sequence; identical to SEQ ID NO: 539
  Description of Artificial Sequence: Synthetic polypeptide

SEQ ID NO: 572 - protein, 452 aa, Artificial Sequence; identical to SEQ ID NO: 58
  Description of Artificial Sequence: Synthetic polypeptide

SEQ ID NO: 573 - protein, 219 aa, Artificial Sequence; identical to SEQ ID NO: 539
  Description of Artificial Sequence: Synthetic polypeptide

SEQ ID NO: 574 - protein, 452 aa, Artificial Sequence; identical to SEQ ID NO: 58
  Description of Artificial Sequence: Synthetic polypeptide

SEQ ID NO: 575 - protein, 219 aa, Artificial Sequence; identical to SEQ ID NO: 539
  Description of Artificial Sequence: Synthetic polypeptide

SEQ ID NO: 576 - protein, 452 aa, Artificial Sequence; identical to SEQ ID NO: 58
  Description of Artificial Sequence: Synthetic polypeptide

SEQ ID NO: 577 - protein, 219 aa, Artificial Sequence; identical to SEQ ID NO: 539
  Description of Artificial Sequence: Synthetic polypeptide

SEQ ID NO: 578 - protein, 452 aa, Artificial Sequence; identical to SEQ ID NO: 58
  Description of Artificial Sequence: Synthetic polypeptide

SEQ ID NO: 579 - protein, 219 aa, Artificial Sequence; identical to SEQ ID NO: 539
  Description of Artificial Sequence: Synthetic polypeptide

SEQ ID NO: 580 - protein, 452 aa, Artificial Sequence; identical to SEQ ID NO: 58
  Description of Artificial Sequence: Synthetic polypeptide

SEQ ID NO: 581 - protein, 219 aa, Artificial Sequence; identical to SEQ ID NO: 539
  Description of Artificial Sequence: Synthetic polypeptide

SEQ ID NO: 582 - protein, 452 aa, Artificial Sequence; identical to SEQ ID NO: 58
  Description of Artificial Sequence: Synthetic polypeptide

SEQ ID NO: 583 - protein, 219 aa, Artificial Sequence; identical to SEQ ID NO: 539
  Description of Artificial Sequence: Synthetic polypeptide

SEQ ID NO: 584 - protein, 452 aa, Artificial Sequence; identical to SEQ ID NO: 58
  Description of Artificial Sequence: Synthetic polypeptide

SEQ ID NO: 585 - protein, 219 aa, Artificial Sequence; identical to SEQ ID NO: 539
  Description of Artificial Sequence: Synthetic polypeptide

SEQ ID NO: 586 - protein, 452 aa, Artificial Sequence; identical to SEQ ID NO: 58
  Description of Artificial Sequence: Synthetic polypeptide

SEQ ID NO: 587 - protein, 219 aa, Artificial Sequence; identical to SEQ ID NO: 539
  Description of Artificial Sequence: Synthetic polypeptide

SEQ ID NO: 588 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 589 - protein, 219 aa, Artificial Sequence; identical to SEQ ID NO: 61
  Description of Artificial Sequence: Synthetic polypeptide

SEQ ID NO: 590 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 591 - protein, 219 aa, Artificial Sequence; identical to SEQ ID NO: 61
  Description of Artificial Sequence: Synthetic polypeptide

SEQ ID NO: 592 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYDYDSFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 593 - protein, 219 aa, Artificial Sequence; identical to SEQ ID NO: 61
  Description of Artificial Sequence: Synthetic polypeptide

SEQ ID NO: 594 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLAYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 595 - protein, 219 aa, Artificial Sequence; identical to SEQ ID NO: 61
  Description of Artificial Sequence: Synthetic polypeptide

SEQ ID NO: 596 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 597 - protein, 219 aa, Artificial Sequence; identical to SEQ ID NO: 61
  Description of Artificial Sequence: Synthetic polypeptide

SEQ ID NO: 598 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 599 - protein, 219 aa, Artificial Sequence; identical to SEQ ID NO: 61
  Description of Artificial Sequence: Synthetic polypeptide

SEQ ID NO: 600 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLAYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 601 - protein, 219 aa, Artificial Sequence; identical to SEQ ID NO: 61
  Description of Artificial Sequence: Synthetic polypeptide

SEQ ID NO: 602 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLAYSIYYADSVKGRFTISRDNAKNSLYLQMNSLRAEDTAVYYCARAPYDYDSFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 603 - protein, 219 aa, Artificial Sequence; identical to SEQ ID NO: 61
  Description of Artificial Sequence: Synthetic polypeptide

SEQ ID NO: 604 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 605 - protein, 219 aa, Artificial Sequence; identical to SEQ ID NO: 61
  Description of Artificial Sequence: Synthetic polypeptide

SEQ ID NO: 606 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 607 - protein, 219 aa, Artificial Sequence; identical to SEQ ID NO: 61
  Description of Artificial Sequence: Synthetic polypeptide

SEQ ID NO: 608 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 609 - protein, 219 aa, Artificial Sequence; identical to SEQ ID NO: 61
  Description of Artificial Sequence: Synthetic polypeptide

SEQ ID NO: 610 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYDYDSFHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 611 - protein, 219 aa, Artificial Sequence; identical to SEQ ID NO: 61
  Description of Artificial Sequence: Synthetic polypeptide

SEQ ID NO: 612 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYDYDSFHPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 613 - protein, 219 aa, Artificial Sequence; identical to SEQ ID NO: 61
  Description of Artificial Sequence: Synthetic polypeptide

SEQ ID NO: 614 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLAYSIYYADSVKGRFTISRDNAKNSLYLQMNSLRAEDTAVYYCARAPYDYDSFHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 615 - protein, 219 aa, Artificial Sequence; identical to SEQ ID NO: 61
  Description of Artificial Sequence: Synthetic polypeptide

SEQ ID NO: 616 - protein, 452 aa, Artificial Sequence
  Description of Artificial Sequence: Synthetic polypeptide
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 617 - protein, 219 aa, Artificial Sequence; identical to SEQ ID NO: 61
  Description of Artificial Sequence: Synthetic polypeptide

SEQ ID NO: 618 - protein, 452 aa, Artificial Sequence
  Description of Artificial Sequence: Synthetic polypeptide
EVQLVESGGGLVQPGGSLRLSCAASGFTFKTYGMAWFRQAPGKGPEWVSFISNLGYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 619 - protein, 219 aa, Artificial Sequence; identical to SEQ ID NO: 61
  Description of Artificial Sequence: Synthetic polypeptide

SEQ ID NO: 620 - protein, 452 aa, Artificial Sequence
  Description of Artificial Sequence: Synthetic polypeptide
EVQLVESGGGLVQPGGSLRLSCAASGFTFQTYGMAWFRQAPGKGPEWVSFISNLGYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 621 - protein, 219 aa, Artificial Sequence; identical to SEQ ID NO: 61
  Description of Artificial Sequence: Synthetic polypeptide

SEQ ID NO: 622 - protein, 452 aa, Artificial Sequence
  Description of Artificial Sequence: Synthetic polypeptide
EVQLVESGGGLVQPGGSLRLSCAASGFTFHTYGMAWFRQAPGKGPEWVSFISNLGYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 623 - protein, 219 aa, Artificial Sequence; identical to SEQ ID NO: 61
  Description of Artificial Sequence: Synthetic polypeptide

SEQ ID NO: 624 - protein, 452 aa, Artificial Sequence
  Description of Artificial Sequence: Synthetic polypeptide
EVQLVESGGGLVQPGGSLRLSCAASGFTFSTYGMAWFRQAPGKGLEWVSFISNLGYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 625 - protein, 219 aa, Artificial Sequence; identical to SEQ ID NO: 61
  Description of Artificial Sequence: Synthetic polypeptide

SEQ ID NO: 626 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFITNLGYSIYYADSVKGRFTISRDNAKNSLYLQMNSLRAEDTAVYYCARAPYDYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 219 aa, Artificial Sequence; identical to SEQ ID NO: 61
  Description of Artificial Sequence: Synthetic polypeptide

SEQ ID NO: 628 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYLYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 629 - protein, 219 aa, Artificial Sequence; identical to SEQ ID NO: 61
  Description of Artificial Sequence: Synthetic polypeptide

SEQ ID NO: 630 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYNYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 631 - protein, 219 aa, Artificial Sequence; identical to SEQ ID NO: 61
  Description of Artificial Sequence: Synthetic polypeptide

SEQ ID NO: 632 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYQYDSFDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 633 - protein, 219 aa, Artificial Sequence; identical to SEQ ID NO: 61
  Description of Artificial Sequence: Synthetic polypeptide

SEQ ID NO: 634 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYDYDSFFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 635 - protein, 219 aa, Artificial Sequence; identical to SEQ ID NO: 61
  Description of Artificial Sequence: Synthetic polypeptide

SEQ ID NO: 636 - protein, 452 aa, Artificial Sequence
  Description of Artificial Sequence: Synthetic polypeptide
EVQLVESGGGLVQPGGSLRLSCAASGFTFSTYGMAWFRQAPGKGPEWVSFISNLGYSIYYADSVKGRFTISRDNAKNSLYLQMNSLRAEDTAVYYCARAPYDYDSFVAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 637 - protein, 219 aa, Artificial Sequence; identical to SEQ ID NO: 61
  Description of Artificial Sequence: Synthetic polypeptide

SEQ ID NO: 638 - protein, 452 aa, Artificial Sequence; identical to SEQ ID NO: 502
  Description of Artificial Sequence: Synthetic polypeptide

SEQ ID NO: 639 - protein, 219 aa, Artificial Sequence; identical to SEQ ID NO: 539
  Description of Artificial Sequence: Synthetic polypeptide

SEQ ID NO: 640 - protein, 452 aa, Artificial Sequence; identical to SEQ ID NO: 502
  Description of Artificial Sequence: Synthetic polypeptide

SEQ ID NO: 641 - protein, 219 aa, Artificial Sequence; identical to SEQ ID NO: 539
  Description of Artificial Sequence: Synthetic polypeptide

SEQ ID NO: 642 - protein, 452 aa, Artificial Sequence; identical to SEQ ID NO: 502
  Description of Artificial Sequence: Synthetic polypeptide

SEQ ID NO: 643 - protein, 219 aa, Artificial Sequence; identical to SEQ ID NO: 539
  Description of Artificial Sequence: Synthetic polypeptide

SEQ ID NO: 644 - protein, 452 aa, Artificial Sequence; identical to SEQ ID NO: 604
  Description of Artificial Sequence: Synthetic polypeptide

SEQ ID NO: 645 - protein, 219 aa, Artificial Sequence; identical to SEQ ID NO: 147
  Description of Artificial Sequence: Synthetic polypeptide

SEQ ID NO: 646 - protein, 452 aa, Artificial Sequence; identical to SEQ ID NO: 604
  Description of Artificial Sequence: Synthetic polypeptide

SEQ ID NO: 647 - protein, 219 aa, Artificial Sequence; identical to SEQ ID NO: 539
  Description of Artificial Sequence: Synthetic polypeptide

SEQ ID NO: 648 - protein, 452 aa, Artificial Sequence; identical to SEQ ID NO: 604
  Description of Artificial Sequence: Synthetic polypeptide

SEQ ID NO: 649 - protein, 219 aa, Artificial Sequence; identical to SEQ ID NO: 539
  Description of Artificial Sequence: Synthetic polypeptide

SEQ ID NO: 650 - protein, 452 aa, Artificial Sequence; identical to SEQ ID NO: 604
  Description of Artificial Sequence: Synthetic polypeptide

SEQ ID NO: 651 - protein, 219 aa, Artificial Sequence; identical to SEQ ID NO: 539
  Description of Artificial Sequence: Synthetic polypeptide

SEQ ID NO: 652 - protein, 452 aa, Artificial Sequence; identical to SEQ ID NO: 604
  Description of Artificial Sequence: Synthetic polypeptide

SEQ ID NO: 653 - protein, 219 aa, Artificial Sequence; identical to SEQ ID NO: 221
  Description of Artificial Sequence: Synthetic polypeptide

SEQ ID NO: 654 - protein, 452 aa, Artificial Sequence; identical to SEQ ID NO: 502
  Description of Artificial Sequence: Synthetic polypeptide

SEQ ID NO: 655 - protein, 219 aa, Artificial Sequence; identical to SEQ ID NO: 539
  Description of Artificial Sequence: Synthetic polypeptide

SEQ ID NO: 656 - protein, 452 aa, Artificial Sequence; identical to SEQ ID NO: 604
  Description of Artificial Sequence: Synthetic polypeptide

SEQ ID NO: 657 - protein, 219 aa, Artificial Sequence; identical to SEQ ID NO: 539
  Description of Artificial Sequence: Synthetic polypeptide

SEQ ID NO: 658 - protein, 452 aa, Artificial Sequence
  Description of Artificial Sequence: Synthetic polypeptide
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 659 - protein, 219 aa, Artificial Sequence; identical to SEQ ID NO: 147
  Description of Artificial Sequence: Synthetic polypeptide

SEQ ID NO: 660 - protein, 451 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 661 - protein, 724 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 662 - protein, 219 aa, Artificial Sequence; identical to SEQ ID NO: 61
  Description of Artificial Sequence: Synthetic polypeptide

SEQ ID NO: 663 - protein, 451 aa, Artificial Sequence; identical to SEQ ID NO: 660
  Description of Artificial Sequence: Synthetic polypeptide

SEQ ID NO: 664 - protein, 724 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 665 - protein, 219 aa, Artificial Sequence; identical to SEQ ID NO: 61
  Description of Artificial Sequence: Synthetic polypeptide

SEQ ID NO: 666 - protein, 451 aa, Artificial Sequence; identical to SEQ ID NO: 660
  Description of Artificial Sequence: Synthetic polypeptide

SEQ ID NO: 667 - protein, 724 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 668 - protein, 219 aa, Artificial Sequence; identical to SEQ ID NO: 61
  Description of Artificial Sequence: Synthetic polypeptide

SEQ ID NO: 669 - protein, 451 aa, Artificial Sequence; identical to SEQ ID NO: 660
  Description of Artificial Sequence: Synthetic polypeptide

SEQ ID NO: 670 - protein, 485 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 671 - protein, 219 aa, Artificial Sequence; identical to SEQ ID NO: 61
  Description of Artificial Sequence: Synthetic polypeptide

SEQ ID NO: 672 - protein, 451 aa, Artificial Sequence; identical to SEQ ID NO: 660
  Description of Artificial Sequence: Synthetic polypeptide

SEQ ID NO: 673 - protein, 485 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 674 - protein, 219 aa, Artificial Sequence; identical to SEQ ID NO: 61
  Description of Artificial Sequence: Synthetic polypeptide

SEQ ID NO: 675 - protein, 451 aa, Artificial Sequence; identical to SEQ ID NO: 660
  Description of Artificial Sequence: Synthetic polypeptide

SEQ ID NO: 676 - protein, 485 aa, Artificial Sequence
  Description of Artificial Sequence: Synthetic polypeptide
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 677 - protein, 219 aa, Artificial Sequence; identical to SEQ ID NO: 61
  Description of Artificial Sequence: Synthetic polypeptide

SEQ ID NO: 678 - protein, 451 aa, Artificial Sequence
  Description of Artificial Sequence: Synthetic polypeptide
QVQLVESGGGLVKPGGSLKLSCAASGFTFSDYGMAWFRQAPGKGPEWVAFISNLAYSIYYADSVKGRFTISRDNSKNTLYLQMNSLRAEDTAVYYCARAPYDYDSFYPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 679 - protein, 485 aa, Artificial Sequence; identical to SEQ ID NO: 670
  Description of Artificial Sequence: Synthetic polypeptide

SEQ ID NO: 680 - protein, 219 aa, Artificial Sequence; identical to SEQ ID NO: 61
  Description of Artificial Sequence: Synthetic polypeptide

SEQ ID NO: 681 - protein, 451 aa, Artificial Sequence; identical to SEQ ID NO: 678
  Description of Artificial Sequence: Synthetic polypeptide

SEQ ID NO: 682 - protein, 485 aa, Artificial Sequence; identical to SEQ ID NO: 673
  Description of Artificial Sequence: Synthetic polypeptide

SEQ ID NO: 683 - protein, 219 aa, Artificial Sequence; identical to SEQ ID NO: 61
  Description of Artificial Sequence: Synthetic polypeptide

SEQ ID NO: 684 - protein, 451 aa, Artificial Sequence; identical to SEQ ID NO: 678
  Description of Artificial Sequence: Synthetic polypeptide

SEQ ID NO: 685 - protein, 485 aa, Artificial Sequence; identical to SEQ ID NO: 676
  Description of Artificial Sequence: Synthetic polypeptide

SEQ ID NO: 686 - protein, 219 aa, Artificial Sequence; identical to SEQ ID NO: 61
  Description of Artificial Sequence: Synthetic polypeptide

SEQ ID NO: 687 - protein, 451 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 688 - protein, 485 aa, Artificial Sequence; identical to SEQ ID NO: 670
  Description of Artificial Sequence: Synthetic polypeptide

SEQ ID NO: 689 - protein, 219 aa, Artificial Sequence; identical to SEQ ID NO: 61
  Description of Artificial Sequence: Synthetic polypeptide

SEQ ID NO: 690 - protein, 451 aa, Artificial Sequence; identical to SEQ ID NO: 687
  Description of Artificial Sequence: Synthetic polypeptide

SEQ ID NO: 691 - protein, 485 aa, Artificial Sequence; identical to SEQ ID NO: 670
  Description of Artificial Sequence: Synthetic polypeptide

SEQ ID NO: 692 - protein, 219 aa, Artificial Sequence; identical to SEQ ID NO: 147
  Description of Artificial Sequence: Synthetic polypeptide

SEQ ID NO: 693 - protein, 451 aa, Artificial Sequence; identical to SEQ ID NO: 687
  Description of Artificial Sequence: Synthetic polypeptide

SEQ ID NO: 694 - protein, 485 aa, Artificial Sequence; identical to SEQ ID NO: 670
  Description of Artificial Sequence: Synthetic polypeptide

SEQ ID NO: 695 - protein, 219 aa, Artificial Sequence; identical to SEQ ID NO: 221
  Description of Artificial Sequence: Synthetic polypeptide

SEQ ID NO: 696 - protein, 451 aa, Artificial Sequence; identical to SEQ ID NO: 687
  Description of Artificial Sequence: Synthetic polypeptide

SEQ ID NO: 697 - protein, 485 aa, Artificial Sequence; identical to SEQ ID NO: 673
  Description of Artificial Sequence: Synthetic polypeptide

SEQ ID NO: 698 - protein, 219 aa, Artificial Sequence; identical to SEQ ID NO: 61
  Description of Artificial Sequence: Synthetic polypeptide

SEQ ID NO: 699 - protein, 451 aa, Artificial Sequence; identical to SEQ ID NO: 687
  Description of Artificial Sequence: Synthetic polypeptide

SEQ ID NO: 700 - protein, 485 aa, Artificial Sequence; identical to SEQ ID NO: 673
  Description of Artificial Sequence: Synthetic polypeptide

SEQ ID NO: 701 - protein, 219 aa, Artificial Sequence; identical to SEQ ID NO: 147
  Description of Artificial Sequence: Synthetic polypeptide

SEQ ID NO: 702 - protein, 451 aa, Artificial Sequence; identical to SEQ ID NO: 687
  Description of Artificial Sequence: Synthetic polypeptide

SEQ ID NO: 703 - protein, 485 aa, Artificial Sequence; identical to SEQ ID NO: 673
  Description of Artificial Sequence: Synthetic polypeptide

SEQ ID NO: 704 - protein, 219 aa, Artificial Sequence; identical to SEQ ID NO: 221
  Description of Artificial Sequence: Synthetic polypeptide

SEQ ID NO: 705 - protein, 451 aa, Artificial Sequence; identical to SEQ ID NO: 687
  Description of Artificial Sequence: Synthetic polypeptide

SEQ ID NO: 706 - protein, 485 aa, Artificial Sequence; identical to SEQ ID NO: 670
  Description of Artificial Sequence: Synthetic polypeptide

SEQ ID NO: 707 - protein, 219 aa, Artificial Sequence; identical to SEQ ID NO: 539
  Description of Artificial Sequence: Synthetic polypeptide

SEQ ID NO: 708 - protein, 451 aa, Artificial Sequence; identical to SEQ ID NO: 687
  Description of Artificial Sequence: Synthetic polypeptide

SEQ ID NO: 709 - protein, 485 aa, Artificial Sequence; identical to SEQ ID NO: 670
  Description of Artificial Sequence: Synthetic polypeptide

SEQ ID NO: 710 - protein, 219 aa, Artificial Sequence; identical to SEQ ID NO: 539
  Description of Artificial Sequence: Synthetic polypeptide

SEQ ID NO: 711 - protein, 451 aa, Artificial Sequence; identical to SEQ ID NO: 687
  Description of Artificial Sequence: Synthetic polypeptide

SEQ ID NO: 712 - protein, 485 aa, Artificial Sequence; identical to SEQ ID NO: 670
  Description of Artificial Sequence: Synthetic polypeptide

SEQ ID NO: 713 - protein, 219 aa, Artificial Sequence; identical to SEQ ID NO: 539
  Description of Artificial Sequence: Synthetic polypeptide

SEQ ID NO: 714 - protein, 451 aa, Artificial Sequence
  Description of Artificial Sequence: Synthetic polypeptide
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 715 - protein, 485 aa, Artificial Sequence; identical to SEQ ID NO: 670
  Description of Artificial Sequence: Synthetic polypeptide

SEQ ID NO: 716 - protein, 219 aa, Artificial Sequence; identical to SEQ ID NO: 61
  Description of Artificial Sequence: Synthetic polypeptide

SEQ ID NO: 717 - protein, 451 aa, Artificial Sequence; identical to SEQ ID NO: 714
  Description of Artificial Sequence: Synthetic polypeptide

SEQ ID NO: 718 - protein, 485 aa, Artificial Sequence; identical to SEQ ID NO: 670
  Description of Artificial Sequence: Synthetic polypeptide

SEQ ID NO: 719 - protein, 219 aa, Artificial Sequence; identical to SEQ ID NO: 147
  Description of Artificial Sequence: Synthetic polypeptide

SEQ ID NO: 720 - protein, 451 aa, Artificial Sequence; identical to SEQ ID NO: 714
  Description of Artificial Sequence: Synthetic polypeptide

SEQ ID NO: 721 - protein, 485 aa, Artificial Sequence; identical to SEQ ID NO: 670
  Description of Artificial Sequence: Synthetic polypeptide

SEQ ID NO: 722 - protein, 219 aa, Artificial Sequence; identical to SEQ ID NO: 539
  Description of Artificial Sequence: Synthetic polypeptide

SEQ ID NO: 723 - protein, 451 aa, Artificial Sequence; identical to SEQ ID NO: 714
  Description of Artificial Sequence: Synthetic polypeptide

SEQ ID NO: 724 - protein, 485 aa, Artificial Sequence; identical to SEQ ID NO: 670
  Description of Artificial Sequence: Synthetic polypeptide

SEQ ID NO: 725 - protein, 219 aa, Artificial Sequence; identical to SEQ ID NO: 539
  Description of Artificial Sequence: Synthetic polypeptide

SEQ ID NO: 726 - protein, 451 aa, Artificial Sequence; identical to SEQ ID NO: 714
  Description of Artificial Sequence: Synthetic polypeptide

SEQ ID NO: 727 - protein, 485 aa, Artificial Sequence; identical to SEQ ID NO: 670
  Description of Artificial Sequence: Synthetic polypeptide

SEQ ID NO: 728 - protein, 219 aa, Artificial Sequence; identical to SEQ ID NO: 539
  Description of Artificial Sequence: Synthetic polypeptide

SEQ ID NO: 729 - protein, 451 aa, Artificial Sequence; identical to SEQ ID NO: 687
  Description of Artificial Sequence: Synthetic polypeptide

SEQ ID NO: 730 - protein, 485 aa, Artificial Sequence; identical to SEQ ID NO: 673
  Description of Artificial Sequence: Synthetic polypeptide

SEQ ID NO: 731 - protein, 219 aa, Artificial Sequence; identical to SEQ ID NO: 539
  Description of Artificial Sequence: Synthetic polypeptide

SEQ ID NO: 732 - protein, 451 aa, Artificial Sequence; identical to SEQ ID NO: 687
  Description of Artificial Sequence: Synthetic polypeptide

SEQ ID NO: 733 - protein, 485 aa, Artificial Sequence; identical to SEQ ID NO: 673
  Description of Artificial Sequence: Synthetic polypeptide

SEQ ID NO: 734 - protein, 219 aa, Artificial Sequence; identical to SEQ ID NO: 539
  Description of Artificial Sequence: Synthetic polypeptide

SEQ ID NO: 735 - protein, 451 aa, Artificial Sequence; identical to SEQ ID NO: 687
  Description of Artificial Sequence: Synthetic polypeptide

SEQ ID NO: 736 - protein, 485 aa, Artificial Sequence; identical to SEQ ID NO: 673
  Description of Artificial Sequence: Synthetic polypeptide

SEQ ID NO: 737 - protein, 219 aa, Artificial Sequence; identical to SEQ ID NO: 539
  Description of Artificial Sequence: Synthetic polypeptide

SEQ ID NO: 738 - protein, 451 aa, Artificial Sequence; identical to SEQ ID NO: 714
  Description of Artificial Sequence: Synthetic polypeptide

SEQ ID NO: 739 - protein, 485 aa, Artificial Sequence; identical to SEQ ID NO: 673
  Description of Artificial Sequence: Synthetic polypeptide

SEQ ID NO: 740 - protein, 219 aa, Artificial Sequence; identical to SEQ ID NO: 61
  Description of Artificial Sequence: Synthetic polypeptide

SEQ ID NO: 741 - protein, 451 aa, Artificial Sequence; identical to SEQ ID NO: 714
  Description of Artificial Sequence: Synthetic polypeptide

SEQ ID NO: 742 - protein, 485 aa, Artificial Sequence; identical to SEQ ID NO: 673
  Description of Artificial Sequence: Synthetic polypeptide

SEQ ID NO: 743 - protein, 219 aa, Artificial Sequence; identical to SEQ ID NO: 147
  Description of Artificial Sequence: Synthetic polypeptide

SEQ ID NO: 744 - protein, 451 aa, Artificial Sequence; identical to SEQ ID NO: 714
  Description of Artificial Sequence: Synthetic polypeptide

SEQ ID NO: 745 - protein, 485 aa, Artificial Sequence; identical to SEQ ID NO: 673
  Description of Artificial Sequence: Synthetic polypeptide

SEQ ID NO: 746 - protein, 219 aa, Artificial Sequence; identical to SEQ ID NO: 539
  Description of Artificial Sequence: Synthetic polypeptide

SEQ ID NO: 747 - protein, 451 aa, Artificial Sequence; identical to SEQ ID NO: 714
  Description of Artificial Sequence: Synthetic polypeptide

SEQ ID NO: 748 - protein, 485 aa, Artificial Sequence; identical to SEQ ID NO: 673
  Description of Artificial Sequence: Synthetic polypeptide

SEQ ID NO: 749 - protein, 219 aa, Artificial Sequence; identical to SEQ ID NO: 539
  Description of Artificial Sequence: Synthetic polypeptide

SEQ ID NO: 750 - protein, 451 aa, Artificial Sequence; identical to SEQ ID NO: 714
  Description of Artificial Sequence: Synthetic polypeptide

SEQ ID NO: 751 - protein, 485 aa, Artificial Sequence; identical to SEQ ID NO: 673
  Description of Artificial Sequence: Synthetic polypeptide

SEQ ID NO: 752 - protein, 219 aa, Artificial Sequence; identical to SEQ ID NO: 539
  Description of Artificial Sequence: Synthetic polypeptide

SEQ ID NO: 753 - protein, 451 aa, Artificial Sequence; identical to SEQ ID NO: 687
  Description of Artificial Sequence: Synthetic polypeptide

SEQ ID NO: 754 - protein, 485 aa, Artificial Sequence; identical to SEQ ID NO: 670
  Description of Artificial Sequence: Synthetic polypeptide

SEQ ID NO: 755 - protein, 219 aa, Artificial Sequence; identical to SEQ ID NO: 539
  Description of Artificial Sequence: Synthetic polypeptide

SEQ ID NO: 756 - protein, 451 aa, Artificial Sequence; identical to SEQ ID NO: 687
  Description of Artificial Sequence: Synthetic polypeptide

SEQ ID NO: 757 - protein, 485 aa, Artificial Sequence; identical to SEQ ID NO: 673
  Description of Artificial Sequence: Synthetic polypeptide

SEQ ID NO: 758 - protein, 219 aa, Artificial Sequence; identical to SEQ ID NO: 539
  Description of Artificial Sequence: Synthetic polypeptide

SEQ ID NO: 759 - protein, 451 aa, Artificial Sequence; identical to SEQ ID NO: 714
  Description of Artificial Sequence: Synthetic polypeptide

SEQ ID NO: 760 - protein, 485 aa, Artificial Sequence; identical to SEQ ID NO: 670
  Description of Artificial Sequence: Synthetic polypeptide

SEQ ID NO: 761 - protein, 219 aa, Artificial Sequence; identical to SEQ ID NO: 539
  Description of Artificial Sequence: Synthetic polypeptide

SEQ ID NO: 762 - protein, 451 aa, Artificial Sequence; identical to SEQ ID NO: 714
  Description of Artificial Sequence: Synthetic polypeptide

SEQ ID NO: 763 - protein, 485 aa, Artificial Sequence; identical to SEQ ID NO: 673
  Description of Artificial Sequence: Synthetic polypeptide

SEQ ID NO: 764 - protein, 219 aa, Artificial Sequence; identical to SEQ ID NO: 539
  Description of Artificial Sequence: Synthetic polypeptide

SEQ ID NO: 765 - protein, 451 aa, Artificial Sequence; identical to SEQ ID NO: 714
  Description of Artificial Sequence: Synthetic polypeptide

SEQ ID NO: 766 - protein, 485 aa, Artificial Sequence; identical to SEQ ID NO: 670
  Description of Artificial Sequence: Synthetic polypeptide

SEQ ID NO: 767 - protein, 219 aa, Artificial Sequence; identical to SEQ ID NO: 221
  Description of Artificial Sequence: Synthetic polypeptide

SEQ ID NO: 768 - protein, 451 aa, Artificial Sequence; identical to SEQ ID NO: 714
  Description of Artificial Sequence: Synthetic polypeptide

SEQ ID NO: 769 - protein, 485 aa, Artificial Sequence; identical to SEQ ID NO: 673
  Description of Artificial Sequence: Synthetic polypeptide

SEQ ID NO: 770 - protein, 219 aa, Artificial Sequence; identical to SEQ ID NO: 221
  Description of Artificial Sequence: Synthetic polypeptide

SEQ ID NO: 771 - protein, 451 aa, Artificial Sequence; identical to SEQ ID NO: 687
  Description of Artificial Sequence: Synthetic polypeptide

SEQ ID NO: 772 - protein, 485 aa, Artificial Sequence; identical to SEQ ID NO: 670
  Description of Artificial Sequence: Synthetic polypeptide

SEQ ID NO: 773 - protein, 219 aa, Artificial Sequence; identical to SEQ ID NO: 539
  Description of Artificial Sequence: Synthetic polypeptide

SEQ ID NO: 774 - protein, 451 aa, Artificial Sequence; identical to SEQ ID NO: 714
  Description of Artificial Sequence: Synthetic polypeptide

SEQ ID NO: 775 - protein, 485 aa, Artificial Sequence; identical to SEQ ID NO: 670
  Description of Artificial Sequence: Synthetic polypeptide

SEQ ID NO: 776 - protein, 219 aa, Artificial Sequence; identical to SEQ ID NO: 539
  Description of Artificial Sequence: Synthetic polypeptide

SEQ ID NO: 777 - protein, 451 aa, Artificial Sequence
  Description of Artificial Sequence: Synthetic polypeptide
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 778 - protein, 485 aa, Artificial Sequence; identical to SEQ ID NO: 670
  Description of Artificial Sequence: Synthetic polypeptide

SEQ ID NO: 779 - protein, 219 aa, Artificial Sequence; identical to SEQ ID NO: 147
  Description of Artificial Sequence: Synthetic polypeptide

SEQ ID NO: 780 - protein, 451 aa, Artificial Sequence; identical to SEQ ID NO: 777
  Description of Artificial Sequence: Synthetic polypeptide

SEQ ID NO: 781 - protein, 485 aa, Artificial Sequence; identical to SEQ ID NO: 673
  Description of Artificial Sequence: Synthetic polypeptide

SEQ ID NO: 782 - protein, 219 aa, Artificial Sequence; identical to SEQ ID NO: 147
  Description of Artificial Sequence: Synthetic polypeptide

SEQ ID NO: 783 - protein, 451 aa, Artificial Sequence; identical to SEQ ID NO: 777
  Description of Artificial Sequence: Synthetic polypeptide

SEQ ID NO: 784 - protein, 485 aa, Artificial Sequence; identical to SEQ ID NO: 670
  Description of Artificial Sequence: Synthetic polypeptide

SEQ ID NO: 785 - protein, 219 aa, Artificial Sequence; identical to SEQ ID NO: 61
  Description of Artificial Sequence: Synthetic polypeptide

SEQ ID NO: 786 - protein, 451 aa, Artificial Sequence; identical to SEQ ID NO: 777
  Description of Artificial Sequence: Synthetic polypeptide

SEQ ID NO: 787 - protein, 485 aa, Artificial Sequence; identical to SEQ ID NO: 670
  Description of Artificial Sequence: Synthetic polypeptide

SEQ ID NO: 788 - protein, 219 aa, Artificial Sequence; identical to SEQ ID NO: 539
  Description of Artificial Sequence: Synthetic polypeptide

SEQ ID NO: 789 - protein, 451 aa, Artificial Sequence; identical to SEQ ID NO: 777
  Description of Artificial Sequence: Synthetic polypeptide

SEQ ID NO: 790 - protein, 485 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 791 - protein, 219 aa, Artificial Sequence; identical to SEQ ID NO: 147
  Description of Artificial Sequence: Synthetic polypeptide

SEQ ID NO: 792 - protein, 451 aa, Artificial Sequence; identical to SEQ ID NO: 777
  Description of Artificial Sequence: Synthetic polypeptide

SEQ ID NO: 793 - protein, 485 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 794 - protein, 219 aa, Artificial Sequence; identical to SEQ ID NO: 147
  Description of Artificial Sequence: Synthetic polypeptide

SEQ ID NO: 795 - protein, 451 aa, Artificial Sequence; identical to SEQ ID NO: 777
  Description of Artificial Sequence: Synthetic polypeptide

SEQ ID NO: 796 - protein, 485 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 797 - protein, 219 aa, Artificial Sequence; identical to SEQ ID NO: 147
  Description of Artificial Sequence: Synthetic polypeptide

SEQ ID NO: 798 - protein, 450 aa, Artificial Sequence
  Description of Artificial Sequence: Synthetic polypeptide
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYTCNVDHKPSNTKVDKKVEPKSCDKTHTCPPCPAPPVAGPSVFLFPPKPKDTLMISRTPEVTCVVVDVKHEDPEVQFNWYVDGVEVHNAKTKPREEQYNSTYRVVSVLTVLHQDWLNGKEYKCKVSNKALPAPIEKTISKAKGQPREPQVYTLPPSQEEMTKNQVSLTCDVSGFYPSDIAVEWESNGQPENNYKTTPPVLDSDGSFFLYSKLTVDKSRWQEGNVFSCSVMHEALHNHYTQKSLSLSPG

SEQ ID NO: 799 - protein, 480 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 800 - protein, 219 aa, Artificial Sequence; identical to SEQ ID NO: 147
  Description of Artificial Sequence: Synthetic polypeptide

SEQ ID NO: 801 - protein, 450 aa, Artificial Sequence; identical to SEQ ID NO: 798
  Description of Artificial Sequence: Synthetic polypeptide

SEQ ID NO: 802 - protein, 480 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 803 - protein, 219 aa, Artificial Sequence; identical to SEQ ID NO: 147
  Description of Artificial Sequence: Synthetic polypeptide

SEQ ID NO: 804 - protein, 449 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 805 - protein, 482 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLS

SEQ ID NO: 806 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 807 - protein, 369 aa, Homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 808 - protein, 369 aa, Macaca fascicularis
MDMVDKPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 809 - protein, 15 aa, Artificial Sequence
  Description of Artificial Sequence: Synthetic peptide
GGGGSGGGGSGGGGS

SEQ ID NO: 810 - protein, 18 aa, Artificial Sequence
  Description of Artificial Sequence: Synthetic peptide
GSTSGSGKPGSGEGSTKG

SEQ ID NO: 811 - protein, 14 aa, Artificial Sequence
  Description of Artificial Sequence: Synthetic peptide
IRPRAIGGSKPRVA

SEQ ID NO: 812 - protein, 15 aa, Artificial Sequence
  Description of Artificial Sequence: Synthetic peptide
GKGGSGKGGSGKGGS

SEQ ID NO: 813 - protein, 15 aa, Artificial Sequence
  Description of Artificial Sequence: Synthetic peptide
GGKGSGGKGSGGKGS

SEQ ID NO: 814 - protein, 15 aa, Artificial Sequence
  Description of Artificial Sequence: Synthetic peptide
GGGKSGGGKSGGGKS

SEQ ID NO: 815 - protein, 15 aa, Artificial Sequence
  Description of Artificial Sequence: Synthetic peptide
GKGKSGKGKSGKGKS

SEQ ID NO: 816 - protein, 15 aa, Artificial Sequence
  Description of Artificial Sequence: Synthetic peptide
GGGKSGGKGSGKGGS

SEQ ID NO: 817 - protein, 15 aa, Artificial Sequence
  Description of Artificial Sequence: Synthetic peptide
GKPGSGKPGSGKPGS

SEQ ID NO: 818 - protein, 20 aa, Artificial Sequence
  Description of Artificial Sequence: Synthetic peptide
GKPGSGKPGSGKPGSGKPGS

SEQ ID NO: 819 - protein, 20 aa, Artificial Sequence
  Description of Artificial Sequence: Synthetic peptide
GKGKSGKGKSGKGKSGKGKS

SEQ ID NO: 820 - protein, 20 aa, Artificial Sequence
  Description of Artificial Sequence: Synthetic peptide
GGGGSGGGGSGGGGSGGGGS

SEQ ID NO: 821 - protein, 14 aa, Artificial Sequence
  Description of Artificial Sequence: Synthetic peptide
STAGDTHLGGEDFD

SEQ ID NO: 822 - protein, 15 aa, Artificial Sequence
  Description of Artificial Sequence: Synthetic peptide
GEGGSGEGGSGEGGS

SEQ ID NO: 823 - protein, 15 aa, Artificial Sequence
  Description of Artificial Sequence: Synthetic peptide
GGEGSGGEGSGGEGS

SEQ ID NO: 824 - protein, 15 aa, Artificial Sequence
  Description of Artificial Sequence: Synthetic peptide
GGGESGGGESGGGES

SEQ ID NO: 825 - protein, 15 aa, Artificial Sequence
  Description of Artificial Sequence: Synthetic peptide
GEGESGEGESGEGES

SEQ ID NO: 826 - protein, 15 aa, Artificial Sequence
  Description of Artificial Sequence: Synthetic peptide
GGGESGGEGSGEGGS

SEQ ID NO: 827 - protein, 20 aa, Artificial Sequence
  Description of Artificial Sequence: Synthetic peptide
GEGESGEGESGEGESGEGES

SEQ ID NO: 828 - protein, 15 aa, Artificial Sequence
  Description of Artificial Sequence: Synthetic peptide
GGGGSGGGGSGGGGS

SEQ ID NO: 829 - protein, 20 aa, Artificial Sequence
  Description of Artificial Sequence: Synthetic peptide
GGGGSGGGGSGGGGSGGGGS

SEQ ID NO: 830 - protein, 18 aa, Artificial Sequence
  Description of Artificial Sequence: Synthetic peptide
GSTSGSGKPGSGEGSTKG

SEQ ID NO: 831 - protein, 19 aa, Artificial Sequence
  Description of Artificial Sequence: Synthetic peptide
PRGASKSGSASQTGSAPGS

SEQ ID NO: 832 - protein, 19 aa, Artificial Sequence
  Description of Artificial Sequence: Synthetic peptide
GTAAAGAGAAGGAAAGAAG

SEQ ID NO: 833 - protein, 19 aa, Artificial Sequence
  Description of Artificial Sequence: Synthetic peptide
GTSGSSGSGSGGSGSGGGG

SEQ ID NO: 834 - protein, 20 aa, Artificial Sequence
  Description of Artificial Sequence: Synthetic peptide
GKPGSGKPGSGKPGSGKPGS

SEQ ID NO: 835 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 836 - protein, 254 aa, Artificial Sequence; identical to SEQ ID NO: 9
  Description of Artificial Sequence: Synthetic polypeptide

SEQ ID NO: 837 - protein, 125 aa, Artificial Sequence; identical to SEQ ID NO: 1
  Description of Artificial Sequence: Synthetic polypeptide

SEQ ID NO: 838 - protein, 109 aa, Artificial Sequence; identical to SEQ ID NO: 5
  Description of Artificial Sequence: Synthetic polypeptide

SEQ ID NO: 839 - protein, 262 aa, Artificial Sequence; identical to SEQ ID NO: 835
  Description of Artificial Sequence: Synthetic polypeptide

SEQ ID NO: 840 - protein, 254 aa, Artificial Sequence; identical to SEQ ID NO: 9
  Description of Artificial Sequence: Synthetic polypeptide

SEQ ID NO: 841 - protein, 125 aa, Artificial Sequence; identical to SEQ ID NO: 1
  Description of Artificial Sequence: Synthetic polypeptide

SEQ ID NO: 842 - protein, 109 aa, Artificial Sequence; identical to SEQ ID NO: 5
  Description of Artificial Sequence: Synthetic polypeptide

SEQ ID NO: 843 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 844 - protein, 254 aa, Artificial Sequence; identical to SEQ ID NO: 45
  Description of Artificial Sequence: Synthetic polypeptide

SEQ ID NO: 845 - protein, 125 aa, Artificial Sequence; identical to SEQ ID NO: 37
  Description of Artificial Sequence: Synthetic polypeptide

SEQ ID NO: 846 - protein, 109 aa, Artificial Sequence; identical to SEQ ID NO: 5
  Description of Artificial Sequence: Synthetic polypeptide

SEQ ID NO: 847 - protein, 262 aa, Artificial Sequence
  Description of Artificial Sequence: Synthetic polypeptide
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 848 - protein, 254 aa, Artificial Sequence; identical to SEQ ID NO: 54
  Description of Artificial Sequence: Synthetic polypeptide

SEQ ID NO: 849 - protein, 125 aa, Artificial Sequence; identical to SEQ ID NO: 46
  Description of Artificial Sequence: Synthetic polypeptide

SEQ ID NO: 850 - protein, 109 aa, Artificial Sequence; identical to SEQ ID NO: 5
  Description of Artificial Sequence: Synthetic polypeptide

SEQ ID NO: 851 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 852 - protein, 254 aa, Artificial Sequence; identical to SEQ ID NO: 18
  Description of Artificial Sequence: Synthetic polypeptide

SEQ ID NO: 853 - protein, 125 aa, Artificial Sequence; identical to SEQ ID NO: 10
  Description of Artificial Sequence: Synthetic polypeptide

SEQ ID NO: 854 - protein, 109 aa, Artificial Sequence; identical to SEQ ID NO: 5
  Description of Artificial Sequence: Synthetic polypeptide

SEQ ID NO: 855 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGPSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 856 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGPSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 857 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGPSYVSWFAYWGQGTLVTVSS

SEQ ID NO: 858 - protein, 109 aa, Artificial Sequence; identical to SEQ ID NO: 5
  Description of Artificial Sequence: Synthetic polypeptide

SEQ ID NO: 859 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 860 - protein, 254 aa, Artificial Sequence; identical to SEQ ID NO: 27
  Description of Artificial Sequence: Synthetic polypeptide

SEQ ID NO: 861 - protein, 125 aa, Artificial Sequence; identical to SEQ ID NO: 19
  Description of Artificial Sequence: Synthetic polypeptide

SEQ ID NO: 862 - protein, 109 aa, Artificial Sequence; identical to SEQ ID NO: 5
  Description of Artificial Sequence: Synthetic polypeptide

SEQ ID NO: 863 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 864 - protein, 254 aa, Artificial Sequence; identical to SEQ ID NO: 36
  Description of Artificial Sequence: Synthetic polypeptide

SEQ ID NO: 865 - protein, 125 aa, Artificial Sequence; identical to SEQ ID NO: 28
  Description of Artificial Sequence: Synthetic polypeptide

SEQ ID NO: 866 - protein, 109 aa, Artificial Sequence; identical to SEQ ID NO: 5
  Description of Artificial Sequence: Synthetic polypeptide

SEQ ID NO: 867 - protein, 262 aa, Artificial Sequence; identical to SEQ ID NO: 851
  Description of Artificial Sequence: Synthetic polypeptide

SEQ ID NO: 868 - protein, 254 aa, Artificial Sequence; identical to SEQ ID NO: 18
  Description of Artificial Sequence: Synthetic polypeptide

SEQ ID NO: 869 - protein, 125 aa, Artificial Sequence; identical to SEQ ID NO: 10
  Description of Artificial Sequence: Synthetic polypeptide

SEQ ID NO: 870 - protein, 109 aa, Artificial Sequence; identical to SEQ ID NO: 5
  Description of Artificial Sequence: Synthetic polypeptide

SEQ ID NO: 871 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 872 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 873 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFAYWGQGTLVTVSS

SEQ ID NO: 874 - protein, 109 aa, Artificial Sequence; identical to SEQ ID NO: 5
  Description of Artificial Sequence: Synthetic polypeptide

SEQ ID NO: 875 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGESYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 876 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGESYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 877 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGESYVSWFAYWGQGTLVTVSS

SEQ ID NO: 878 - protein, 109 aa, Artificial Sequence; identical to SEQ ID NO: 5
  Description of Artificial Sequence: Synthetic polypeptide

SEQ ID NO: 879 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 880 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 881 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSS

SEQ ID NO: 882 - protein, 109 aa, Artificial Sequence; identical to SEQ ID NO: 5
  Description of Artificial Sequence: Synthetic polypeptide

SEQ ID NO: 883 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 884 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 885 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFAYWGQGTLVTVSS

SEQ ID NO: 886 - protein, 109 aa, Artificial Sequence; identical to SEQ ID NO: 5
  Description of Artificial Sequence: Synthetic polypeptide

SEQ ID NO: 887 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 888 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 889 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFAYWGQGTLVTVSS

SEQ ID NO: 890 - protein, 109 aa, Artificial Sequence; identical to SEQ ID NO: 5
  Description of Artificial Sequence: Synthetic polypeptide

SEQ ID NO: 891 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 892 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 893 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFDYWGQGTLVTVSS

SEQ ID NO: 894 - protein, 109 aa, Artificial Sequence; identical to SEQ ID NO: 5
  Description of Artificial Sequence: Synthetic polypeptide

SEQ ID NO: 895 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 896 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 897 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFDYWGQGTLVTVSS

SEQ ID NO: 898 - protein, 109 aa, Artificial Sequence; identical to SEQ ID NO: 5
  Description of Artificial Sequence: Synthetic polypeptide

SEQ ID NO: 899 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGASYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 900 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGASYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 901 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGASYVSWFDYWGQGTLVTVSS

SEQ ID NO: 902 - protein, 109 aa, Artificial Sequence; identical to SEQ ID NO: 5
  Description of Artificial Sequence: Synthetic polypeptide

SEQ ID NO: 903 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 904 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 905 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFDYWGQGTLVTVSS

SEQ ID NO: 906 - protein, 109 aa, Artificial Sequence; identical to SEQ ID NO: 5
  Description of Artificial Sequence: Synthetic polypeptide

SEQ ID NO: 907 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 908 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 909 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFDYWGQGTLVTVSS

SEQ ID NO: 910 - protein, 109 aa, Artificial Sequence; identical to SEQ ID NO: 5
  Description of Artificial Sequence: Synthetic polypeptide

SEQ ID NO: 911 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 912 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 913 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFDYWGQGTLVTVSS

SEQ ID NO: 914 - protein, 109 aa, Artificial Sequence; identical to SEQ ID NO: 5
  Description of Artificial Sequence: Synthetic polypeptide

SEQ ID NO: 915 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 916 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 917 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFDYWGQGTLVTVSS

SEQ ID NO: 918 - protein, 109 aa, Artificial Sequence; identical to SEQ ID NO: 5
  Description of Artificial Sequence: Synthetic polypeptide

SEQ ID NO: 919 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 920 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 921 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFDYWGQGTLVTVSS

SEQ ID NO: 922 - protein, 109 aa, Artificial Sequence; identical to SEQ ID NO: 5
  Description of Artificial Sequence: Synthetic polypeptide

SEQ ID NO: 923 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 924 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 925 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFAYWGQGTLVTVSS

SEQ ID NO: 926 - protein, 109 aa, Artificial Sequence; identical to SEQ ID NO: 5
  Description of Artificial Sequence: Synthetic polypeptide

SEQ ID NO: 927 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGASYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 928 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGASYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 929 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGASYVSWFAYWGQGTLVTVSS

SEQ ID NO: 930 - protein, 109 aa, Artificial Sequence; identical to SEQ ID NO: 5
  Description of Artificial Sequence: Synthetic polypeptide

SEQ ID NO: 931 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 932 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 933 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGQSYVSWFAYWGQGTLVTVSS

SEQ ID NO: 934 - protein, 109 aa, Artificial Sequence; identical to SEQ ID NO: 5
  Description of Artificial Sequence: Synthetic polypeptide

SEQ ID NO: 935 - protein, 262 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 936 - protein, 254 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 937 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFDYWGQGTLVTVSS

SEQ ID NO: 938 - protein, 109 aa, Artificial Sequence; identical to SEQ ID NO: 5
  Description of Artificial Sequence: Synthetic polypeptide

SEQ ID NO: 939 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 940 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 941 - protein, 107 aa, Artificial Sequence [sequence omitted]

SEQ ID NO: 942 - protein, 329 aa, Artificial Sequence; identical to SEQ ID NO: 939
  Description of Artificial Sequence: Synthetic polypeptide

SEQ ID NO: 943 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 944 - protein, 107 aa, Artificial Sequence [sequence omitted]

SEQ ID NO: 945 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 946 - protein, 231 aa, Artificial Sequence; identical to SEQ ID NO: 943
  Description of Artificial Sequence: Synthetic polypeptide

SEQ ID NO: 947 - protein, 107 aa, Artificial Sequence [sequence omitted]

SEQ ID NO: 948 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKSGFYPSDIAVEWESDGQPENNYKTTPPVLDSDGSFFLYSKLEVDKSRWEQGDVFSCSVMHEALHNHYTQKSLSLSPGK

SEQ ID NO: 949 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 950 - protein, 107 aa, Artificial Sequence [sequence omitted]

SEQ ID NO: 951 - protein, 329 aa, Artificial Sequence; identical to SEQ ID NO: 939
  Description of Artificial Sequence: Synthetic polypeptide

SEQ ID NO: 952 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 953 - protein, 107 aa, Artificial Sequence [sequence omitted]

SEQ ID NO: 954 - protein, 4 aa, Artificial Sequence
  Description of Artificial Sequence: Synthetic peptide
EPKS

SEQ ID NO: 955 - protein, 5 aa, Artificial Sequence
  Description of Artificial Sequence: Synthetic peptide
GSGGS

SEQ ID NO: 956 - protein, 5 aa, Artificial Sequence
  Description of Artificial Sequence: Synthetic peptide
GGGGS

SEQ ID NO: 957 - protein, 4 aa, Artificial Sequence
  Description of Artificial Sequence: Synthetic peptide
GGGS

SEQ ID NO: 958 - protein, 121 aa, Artificial Sequence
  Description of Artificial Sequence: Synthetic polypeptide
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDPMDYWGQGTLVTVS

SEQ ID NO: 959 - protein, 5 aa, Artificial Sequence
  Description of Artificial Sequence: Synthetic peptide
DYGMA

SEQ ID NO: 960 - protein, 17 aa, Artificial Sequence
  Description of Artificial Sequence: Synthetic peptide
FISNLGYSIYYADSVKG

SEQ ID NO: 961 - protein, 13 aa, Artificial Sequence
  Description of Artificial Sequence: Synthetic peptide
APYDYDSFDPMDY

SEQ ID NO: 962 - protein, 112 aa, Artificial Sequence
  Description of Artificial Sequence: Synthetic polypeptide
DIVMTQSPDSLAVSLGERATINCKSSQSLLNSRNRKNYLAWYQQKPDQSPKLLIYWASTRESGVPDRFSGSGSGTDFTLTISSLQAEDVAVYYCKQSYYLWTFGGGTKVEIK

SEQ ID NO: 963 - protein, 17 aa, Artificial Sequence
  Description of Artificial Sequence: Synthetic peptide
KSSQSLLNSRNRKNYLA

SEQ ID NO: 964 - protein, 7 aa, Artificial Sequence
  Description of Artificial Sequence: Synthetic peptide
WASTRES

SEQ ID NO: 965 - protein, 8 aa, Artificial Sequence
  Description of Artificial Sequence: Synthetic peptide
KQSYYLWT

SEQ ID NO: 966 - protein, 122 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFYPMDYWGQGTLVTVSS

SEQ ID NO: 967 - protein, 5 aa, Artificial Sequence
  Description of Artificial Sequence: Synthetic peptide
DYGMA

SEQ ID NO: 968 - protein, 17 aa, Artificial Sequence
  Description of Artificial Sequence: Synthetic peptide
FISNLAYSIYYADSVKG

SEQ ID NO: 969 - protein, 13 aa, Artificial Sequence
  Description of Artificial Sequence: Synthetic peptide
APYDYDSFYPMDY

SEQ ID NO: 970 - protein, 112 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRESGVPDRFSGSGSGTDFTLTISSLQAEDVAVYYCKQSYYLWTFGGGTKVEIK

SEQ ID NO: 971 - protein, 17 aa, Artificial Sequence
  Description of Artificial Sequence: Synthetic peptide
KSSQSLLNSRTRKNYLA

SEQ ID NO: 972 - protein, 7 aa, Artificial Sequence
  Description of Artificial Sequence: Synthetic peptide
WASTRES

SEQ ID NO: 973 - protein, 8 aa, Artificial Sequence
  Description of Artificial Sequence: Synthetic peptide
KQSYYLWT

SEQ ID NO: 974 - protein, 122 aa, Artificial Sequence
  Description of Artificial Sequence: Synthetic polypeptide
EVQLVESGGGLVQPGGSLRLSCAASGFTFSDYGMAWFRQAPGKGPEWVSFISNLAYSIYYADSVKGRFTISRDNAKNSLYLQMNSLRAEDTAVYYCARAPYDYDSFDPMDYWGQGTLVTVSS

SEQ ID NO: 975 - protein, 5 aa, Artificial Sequence
  Description of Artificial Sequence: Synthetic peptide
DYGMA

SEQ ID NO: 976 - protein, 17 aa, Artificial Sequence
  Description of Artificial Sequence: Synthetic peptide
FISNLAYSIYYADSVKG

SEQ ID NO: 977 - protein, 13 aa, Artificial Sequence
  Description of Artificial Sequence: Synthetic peptide
APYDYDSFDPMDY

SEQ ID NO: 978 - protein, 112 aa, Artificial Sequence; identical to SEQ ID NO: 962
  Description of Artificial Sequence: Synthetic polypeptide

SEQ ID NO: 979 - protein, 17 aa, Artificial Sequence
  Description of Artificial Sequence: Synthetic peptide
KSSQSLLNSRNRKNYLA

SEQ ID NO: 980 - protein, 7 aa, Artificial Sequence
  Description of Artificial Sequence: Synthetic peptide
WASTRES

SEQ ID NO: 981 - protein, 8 aa, Artificial Sequence
  Description of Artificial Sequence: Synthetic peptide
KQSYYLWT

SEQ ID NO: 982 - protein, 122 aa, Artificial Sequence; identical to SEQ ID NO: 974
  Description of Artificial Sequence: Synthetic polypeptide

SEQ ID NO: 983 - protein, 5 aa, Artificial Sequence
  Description of Artificial Sequence: Synthetic peptide
DYGMA

SEQ ID NO: 984 - protein, 17 aa, Artificial Sequence
  Description of Artificial Sequence: Synthetic peptide
FISNLAYSIYYADSVKG

SEQ ID NO: 985 - protein, 13 aa, Artificial Sequence
  Description of Artificial Sequence: Synthetic peptide
APYDYDSFDPMDY

SEQ ID NO: 986 - protein, 112 aa, Artificial Sequence
  Description of Artificial Sequence: Synthetic polypeptide
DIVMTQSPDSLAVSLGERATINCKSSQSLLNSRTRKNYLAWYQQKPDQSPKLLIYWASTRASGVPDRFSGSGSGTDFTLTISSLQAEDVAVYYCKQSYYLWTFGGGTKVEIK

SEQ ID NO: 987 - protein, 17 aa, Artificial Sequence
  Description of Artificial Sequence: Synthetic peptide
KSSQSLLNSRTRKNYLA

SEQ ID NO: 988 - protein, 7 aa, Artificial Sequence
  Description of Artificial Sequence: Synthetic peptide
WASTRAS

SEQ ID NO: 989 - protein, 8 aa, Artificial Sequence
  Description of Artificial Sequence: Synthetic peptide
KQSYYLWT

SEQ ID NO: 990 - protein, 122 aa, Artificial Sequence; identical to SEQ ID NO: 974
  Description of Artificial Sequence: Synthetic polypeptide

SEQ ID NO: 991 - protein, 5 aa, Artificial Sequence
  Description of Artificial Sequence: Synthetic peptide
DYGMA

SEQ ID NO: 992 - protein, 17 aa, Artificial Sequence
  Description of Artificial Sequence: Synthetic peptide
FISNLAYSIYYADSVKG

SEQ ID NO: 993 - protein, 13 aa, Artificial Sequence
  Description of Artificial Sequence: Synthetic peptide
APYDYDSFDPMDY

SEQ ID NO: 994 - protein, 112 aa, Artificial Sequence
  Description of Artificial Sequence: Synthetic polypeptide
DIVMTQSPDSLAVSLGERATINCKSSQSLLNSRNRKSYLAWYQQKPDQSPKLLIYYASTRASGVPDRFSGSGSGTDFTLTISSLQAEDVAVYYCKQSYYLWTFGGGTKVEIK

SEQ ID NO: 995 - protein, 17 aa, Artificial Sequence
  Description of Artificial Sequence: Synthetic peptide
KSSQSLLNSRNRKSYLA

SEQ ID NO: 996 - protein, 7 aa, Artificial Sequence
  Description of Artificial Sequence: Synthetic peptide
YASTRAS

SEQ ID NO: 997 - protein, 8 aa, Artificial Sequence
  Description of Artificial Sequence: Synthetic peptide
KQSYYLWT

SEQ ID NO: 998 - protein, 122 aa, Artificial Sequence; identical to SEQ ID NO: 974
  Description of Artificial Sequence: Synthetic polypeptide

SEQ ID NO: 999 - protein, 5 aa, Artificial Sequence
  Description of Artificial Sequence: Synthetic peptide
DYGMA

SEQ ID NO: 1000 - protein, 17 aa, Artificial Sequence
  Description of Artificial Sequence: Synthetic peptide
FISNLAYSIYYADSVKG

SEQ ID NO: 1001 - protein, 13 aa, Artificial Sequence
  Description of Artificial Sequence: Synthetic peptide
APYDYDSFDPMDY

SEQ ID NO: 1002 - protein, 112 aa, Artificial Sequence; identical to SEQ ID NO: 994
  Description of Artificial Sequence: Synthetic polypeptide

SEQ ID NO: 1003 - protein, 17 aa, Artificial Sequence
  Description of Artificial Sequence: Synthetic peptide
KSSQSLLNSRNRKSYLA

SEQ ID NO: 1004 - protein, 7 aa, Artificial Sequence
  Description of Artificial Sequence: Synthetic peptide
YASTRAS

SEQ ID NO: 1005 - protein, 8 aa, Artificial Sequence
  Description of Artificial Sequence: Synthetic peptide
KQSYYLWT

SEQ ID NO: 1006 - protein, 122 aa, Artificial Sequence; identical to SEQ ID NO: 974
  Description of Artificial Sequence: Synthetic polypeptide

SEQ ID NO: 1007 - protein, 5 aa, Artificial Sequence
  Description of Artificial Sequence: Synthetic peptide
DYGMA

SEQ ID NO: 1008 - protein, 17 aa, Artificial Sequence
  Description of Artificial Sequence: Synthetic peptide
FISNLAYSIYYADSVKG

SEQ ID NO: 1009 - protein, 13 aa, Artificial Sequence
  Description of Artificial Sequence: Synthetic peptide
APYDYDSFDPMDY

SEQ ID NO: 1010 - protein, 112 aa, Artificial Sequence; identical to SEQ ID NO: 994
  Description of Artificial Sequence: Synthetic polypeptide

SEQ ID NO: 1011 - protein, 17 aa, Artificial Sequence
  Description of Artificial Sequence: Synthetic peptide
KSSQSLLNSRNRKSYLA

SEQ ID NO: 1012 - protein, 7 aa, Artificial Sequence
  Description of Artificial Sequence: Synthetic peptide
YASTRAS

SEQ ID NO: 1013 - protein, 8 aa, Artificial Sequence
  Description of Artificial Sequence: Synthetic peptide
KQSYYLWT

SEQ ID NO: 1014 - protein, 122 aa, Artificial Sequence; identical to SEQ ID NO: 974
  Description of Artificial Sequence: Synthetic polypeptide

SEQ ID NO: 1015 - protein, 5 aa, Artificial Sequence
  Description of Artificial Sequence: Synthetic peptide
DYGMA

SEQ ID NO: 1016 - protein, 17 aa, Artificial Sequence
  Description of Artificial Sequence: Synthetic peptide
FISNLAYSIYYADSVKG

SEQ ID NO: 1017 - protein, 13 aa, Artificial Sequence
  Description of Artificial Sequence: Synthetic peptide
APYDYDSFDPMDY

SEQ ID NO: 1018 - protein, 112 aa, Artificial Sequence; identical to SEQ ID NO: 994
  Description of Artificial Sequence: Synthetic polypeptide

SEQ ID NO: 1019 - protein, 17 aa, Artificial Sequence
  Description of Artificial Sequence: Synthetic peptide
KSSQSLLNSRNRKSYLA

SEQ ID NO: 1020 - protein, 7 aa, Artificial Sequence
  Description of Artificial Sequence: Synthetic peptide
YASTRAS

SEQ ID NO: 1021 - protein, 8 aa, Artificial Sequence
  Description of Artificial Sequence: Synthetic peptide
KQSYYLWT

SEQ ID NO: 1022 - protein, 122 aa, Artificial Sequence
  Description of Artificial Sequence: Synthetic polypeptide
EVQLVESGGGLVQPGGSLRLSCAASGFTFSDYGMAWFRQAPGKGPEWVSFISNLGYSIYYADSVKGRFTISRDNAKNSLYLQMNSLRAEDTAVYYCARAPYDYDSFDPMDYWGQGTLVTVSS

SEQ ID NO: 1023 - protein, 5 aa, Artificial Sequence
  Description of Artificial Sequence: Synthetic peptide
DYGMA

SEQ ID NO: 1024 - protein, 17 aa, Artificial Sequence
  Description of Artificial Sequence: Synthetic peptide
FISNLGYSIYYADSVKG

SEQ ID NO: 1025 - protein, 13 aa, Artificial Sequence
  Description of Artificial Sequence: Synthetic peptide
APYDYDSFDPMDY

SEQ ID NO: 1026 - protein, 112 aa, Artificial Sequence; identical to SEQ ID NO: 962
  Description of Artificial Sequence: Synthetic polypeptide

SEQ ID NO: 1027 - protein, 17 aa, Artificial Sequence
  Description of Artificial Sequence: Synthetic peptide
KSSQSLLNSRNRKNYLA

SEQ ID NO: 1028 - protein, 7 aa, Artificial Sequence
  Description of Artificial Sequence: Synthetic peptide
WASTRES

SEQ ID NO: 1029 - protein, 8 aa, Artificial Sequence
  Description of Artificial Sequence: Synthetic peptide
KQSYYLWT

SEQ ID NO: 1030 - protein, 122 aa, Artificial Sequence; identical to SEQ ID NO: 1022
  Description of Artificial Sequence: Synthetic polypeptide

SEQ ID NO: 1031 - protein, 5 aa, Artificial Sequence
  Description of Artificial Sequence: Synthetic peptide
DYGMA

SEQ ID NO: 1032 - protein, 17 aa, Artificial Sequence
  Description of Artificial Sequence: Synthetic peptide
FISNLGYSIYYADSVKG

SEQ ID NO: 1033 - protein, 13 aa, Artificial Sequence
  Description of Artificial Sequence: Synthetic peptide
APYDYDSFDPMDY

SEQ ID NO: 1034 - protein, 112 aa, Artificial Sequence; identical to SEQ ID NO: 986
  Description of Artificial Sequence: Synthetic polypeptide

SEQ ID NO: 1035 - protein, 17 aa, Artificial Sequence
  Description of Artificial Sequence: Synthetic peptide
KSSQSLLNSRTRKNYLA

SEQ ID NO: 1036 - protein, 7 aa, Artificial Sequence
  Description of Artificial Sequence: Synthetic peptide
WASTRAS

SEQ ID NO: 1037 - protein, 8 aa, Artificial Sequence
  Description of Artificial Sequence: Synthetic peptide
KQSYYLWT

SEQ ID NO: 1038 - protein, 122 aa, Artificial Sequence; identical to SEQ ID NO: 1022
  Description of Artificial Sequence: Synthetic polypeptide

SEQ ID NO: 1039 - protein, 5 aa, Artificial Sequence
  Description of Artificial Sequence: Synthetic peptide
DYGMA

SEQ ID NO: 1040 - protein, 17 aa, Artificial Sequence
  Description of Artificial Sequence: Synthetic peptide
FISNLGYSIYYADSVKG

SEQ ID NO: 1041 - protein, 13 aa, Artificial Sequence
  Description of Artificial Sequence: Synthetic peptide
APYDYDSFDPMDY

SEQ ID NO: 1042 - protein, 112 aa, Artificial Sequence; identical to SEQ ID NO: 994
  Description of Artificial Sequence: Synthetic polypeptide

SEQ ID NO: 1043 - protein, 17 aa, Artificial Sequence
  Description of Artificial Sequence: Synthetic peptide
KSSQSLLNSRNRKSYLA

SEQ ID NO: 1044 - protein, 7 aa, Artificial Sequence
  Description of Artificial Sequence: Synthetic peptide
YASTRAS

SEQ ID NO: 1045 - protein, 8 aa, Artificial Sequence
  Description of Artificial Sequence: Synthetic peptide
KQSYYLWT

SEQ ID NO: 1046 - protein, 122 aa, Artificial Sequence; identical to SEQ ID NO: 1022
  Description of Artificial Sequence: Synthetic polypeptide

SEQ ID NO: 1047 - protein, 5 aa, Artificial Sequence
  Description of Artificial Sequence: Synthetic peptide
DYGMA

SEQ ID NO: 1048 - protein, 17 aa, Artificial Sequence
  Description of Artificial Sequence: Synthetic peptide
FISNLGYSIYYADSVKG

SEQ ID NO: 1049 - protein, 13 aa, Artificial Sequence
  Description of Artificial Sequence: Synthetic peptide
APYDYDSFDPMDY

SEQ ID NO: 1050 - protein, 112 aa, Artificial Sequence; identical to SEQ ID NO: 994
  Description of Artificial Sequence: Synthetic polypeptide

SEQ ID NO: 1051 - protein, 17 aa, Artificial Sequence
  Description of Artificial Sequence: Synthetic peptide
KSSQSLLNSRNRKSYLA

SEQ ID NO: 1052 - protein, 7 aa, Artificial Sequence
  Description of Artificial Sequence: Synthetic peptide
YASTRAS

SEQ ID NO: 1053 - protein, 8 aa, Artificial Sequence
  Description of Artificial Sequence: Synthetic peptide
KQSYYLWT

SEQ ID NO: 1054 - protein, 122 aa, Artificial Sequence; identical to SEQ ID NO: 1022
  Description of Artificial Sequence: Synthetic polypeptide

SEQ ID NO: 1055 - protein, 5 aa, Artificial Sequence
  Description of Artificial Sequence: Synthetic peptide
DYGMA

SEQ ID NO: 1056 - protein, 17 aa, Artificial Sequence
  Description of Artificial Sequence: Synthetic peptide
FISNLGYSIYYADSVKG

SEQ ID NO: 1057 - protein, 13 aa, Artificial Sequence
  Description of Artificial Sequence: Synthetic peptide
APYDYDSFDPMDY

SEQ ID NO: 1058 - protein, 112 aa, Artificial Sequence; identical to SEQ ID NO: 994
  Description of Artificial Sequence: Synthetic polypeptide

SEQ ID NO: 1059 - protein, 17 aa, Artificial Sequence
  Description of Artificial Sequence: Synthetic peptide
KSSQSLLNSRNRKSYLA

SEQ ID NO: 1060 - protein, 7 aa, Artificial Sequence
  Description of Artificial Sequence: Synthetic peptide
YASTRAS

SEQ ID NO: 1061 - protein, 8 aa, Artificial Sequence
  Description of Artificial Sequence: Synthetic peptide
KQSYYLWT

SEQ ID NO: 1062 - protein, 122 aa, Artificial Sequence; identical to SEQ ID NO: 1022
  Description of Artificial Sequence: Synthetic polypeptide

SEQ ID NO: 1063 - protein, 5 aa, Artificial Sequence
  Description of Artificial Sequence: Synthetic peptide
DYGMA

SEQ ID NO: 1064 - protein, 17 aa, Artificial Sequence
  Description of Artificial Sequence: Synthetic peptide
FISNLGYSIYYADSVKG

SEQ ID NO: 1065 - protein, 13 aa, Artificial Sequence
  Description of Artificial Sequence: Synthetic peptide
APYDYDSFDPMDY

SEQ ID NO: 1066 - protein, 112 aa, Artificial Sequence; identical to SEQ ID NO: 994
  Description of Artificial Sequence: Synthetic polypeptide

SEQ ID NO: 1067 - protein, 17 aa, Artificial Sequence
  Description of Artificial Sequence: Synthetic peptide
KSSQSLLNSRNRKSYLA

SEQ ID NO: 1068 - protein, 7 aa, Artificial Sequence
  Description of Artificial Sequence: Synthetic peptide
YASTRAS

SEQ ID NO: 1069 - protein, 8 aa, Artificial Sequence
  Description of Artificial Sequence: Synthetic peptide
KQSYYLWT

SEQ ID NO: 1070 - protein, 451 aa, Artificial Sequence; identical to SEQ ID NO: 777
  Description of Artificial Sequence: Synthetic polypeptide

SEQ ID NO: 1071 - protein, 122 aa, Artificial Sequence
  Description of Artificial Sequence: Synthetic polypeptide
EVQLVESGGGLVQPGGSLRLSCAASGFTFSDYGMAWFRQAPGKGLEWVSFISNLGYSIYYADSVKGRFTISRDNAKNSLYLQMNSLRAEDTAVYYCARAPYDYDSFDPMDYWGQGTLVTVSS

SEQ ID NO: 1072 - protein, 5 aa, Artificial Sequence
  Description of Artificial Sequence: Synthetic peptide
DYGMA

SEQ ID NO: 1073 - protein, 17 aa, Artificial Sequence
  Description of Artificial Sequence: Synthetic peptide
FISNLGYSIYYADSVKG

SEQ ID NO: 1074 - protein, 13 aa, Artificial Sequence
  Description of Artificial Sequence: Synthetic peptide
APYDYDSFDPMDY

SEQ ID NO: 1075 - protein, 219 aa, Artificial Sequence; identical to SEQ ID NO: 147
  Description of Artificial Sequence: Synthetic polypeptide

SEQ ID NO: 1076 - protein, 112 aa, Artificial Sequence; identical to SEQ ID NO: 962
  Description of Artificial Sequence: Synthetic polypeptide

SEQ ID NO: 1077 - protein, 17 aa, Artificial Sequence
  Description of Artificial Sequence: Synthetic peptide
KSSQSLLNSRNRKNYLA

SEQ ID NO: 1078 - protein, 7 aa, Artificial Sequence
  Description of Artificial Sequence: Synthetic peptide
WASTRES

SEQ ID NO: 1079 - protein, 8 aa, Artificial Sequence
  Description of Artificial Sequence: Synthetic peptide
KQSYYLWT

SEQ ID NO: 1080 - protein, 485 aa, Artificial Sequence; identical to SEQ ID NO: 670
  Description of Artificial Sequence: Synthetic polypeptide

SEQ ID NO: 1081 - protein, 125 aa, Artificial Sequence; identical to SEQ ID NO: 1
  Description of Artificial Sequence: Synthetic polypeptide

SEQ ID NO: 1082 - protein, 5 aa, Artificial Sequence
  Description of Artificial Sequence: Synthetic peptide
TYAMN

SEQ ID NO: 1083 - protein, 19 aa, Artificial Sequence
  Description of Artificial Sequence: Synthetic peptide
RIRSKYNNYATYYADSVKG

SEQ ID NO: 1084 - protein, 14 aa, Artificial Sequence
  Description of Artificial Sequence: Synthetic peptide
HGNFGDSYVSWFAY

SEQ ID NO: 1085 - protein, 109 aa, Artificial Sequence; identical to SEQ ID NO: 5
  Description of Artificial Sequence: Synthetic polypeptide

SEQ ID NO: 1086 - protein, 14 aa, Artificial Sequence
  Description of Artificial Sequence: Synthetic peptide
GSSTGAVTTSNYAN

SEQ ID NO: 1087 - protein, 7 aa, Artificial Sequence
  Description of Artificial Sequence: Synthetic peptide
GTNKRAP

SEQ ID NO: 1088 - protein, 9 aa, Artificial Sequence
  Description of Artificial Sequence: Synthetic peptide
ALWYSNHWV

SEQ ID NO: 1089 - protein, 451 aa, Artificial Sequence; identical to SEQ ID NO: 777
  Description of Artificial Sequence: Synthetic polypeptide

SEQ ID NO: 1090 - protein, 122 aa, Artificial Sequence; identical to SEQ ID NO: 1071
  Description of Artificial Sequence: Synthetic polypeptide

SEQ ID NO: 1091 - protein, 5 aa, Artificial Sequence
  Description of Artificial Sequence: Synthetic peptide
DYGMA

SEQ ID NO: 1092 - protein, 17 aa, Artificial Sequence
  Description of Artificial Sequence: Synthetic peptide
FISNLGYSIYYADSVKG

SEQ ID NO: 1093 - protein, 13 aa, Artificial Sequence
  Description of Artificial Sequence: Synthetic peptide
APYDYDSFDPMDY

SEQ ID NO: 1094 - protein, 219 aa, Artificial Sequence; identical to SEQ ID NO: 147
  Description of Artificial Sequence: Synthetic polypeptide

SEQ ID NO: 1095 - protein, 112 aa, Artificial Sequence; identical to SEQ ID NO: 962
  Description of Artificial Sequence: Synthetic polypeptide

SEQ ID NO: 1096 - protein, 17 aa, Artificial Sequence
  Description of Artificial Sequence: Synthetic peptide
KSSQSLLNSRNRKNYLA

SEQ ID NO: 1097 - protein, 7 aa, Artificial Sequence
  Description of Artificial Sequence: Synthetic peptide
WASTRES

SEQ ID NO: 1098 - protein, 8 aa, Artificial Sequence
  Description of Artificial Sequence: Synthetic peptide
KQSYYLWT

SEQ ID NO: 1099 - protein, 485 aa, Artificial Sequence; identical to SEQ ID NO: 790
  Description of Artificial Sequence: Synthetic polypeptide

SEQ ID NO: 1100 - protein, 125 aa, Artificial Sequence; identical to SEQ ID NO: 10
  Description of Artificial Sequence: Synthetic polypeptide

SEQ ID NO: 1101 - protein, 5 aa, Artificial Sequence
  Description of Artificial Sequence: Synthetic peptide
TYAMN

SEQ ID NO: 1102 - protein, 19 aa, Artificial Sequence
  Description of Artificial Sequence: Synthetic peptide
RIRSKANNYATYYADSVKG

SEQ ID NO: 1103 - protein, 14 aa, Artificial Sequence
  Description of Artificial Sequence: Synthetic peptide
HGNFGDSYVSWFAY

SEQ ID NO: 1104 - protein, 109 aa, Artificial Sequence; identical to SEQ ID NO: 5
  Description of Artificial Sequence: Synthetic polypeptide

SEQ ID NO: 1105 - protein, 14 aa, Artificial Sequence
  Description of Artificial Sequence: Synthetic peptide
GSSTGAVTTSNYAN

SEQ ID NO: 1106 - protein, 7 aa, Artificial Sequence
  Description of Artificial Sequence: Synthetic peptide
GTNKRAP

SEQ ID NO: 1107 - protein, 9 aa, Artificial Sequence
  Description of Artificial Sequence: Synthetic peptide
ALWYSNHWV

SEQ ID NO: 1108 - protein, 329 aa, Artificial Sequence; identical to SEQ ID NO: 939
  Description of Artificial Sequence: Synthetic polypeptide

SEQ ID NO: 1109 - protein, 231 aa, Artificial Sequence; identical to SEQ ID NO: 940
  Description of Artificial Sequence: Synthetic polypeptide

SEQ ID NO: 1110 - protein, 107 aa, Artificial Sequence [sequence omitted]

SEQ ID NO: 1111 - protein, 329 aa, Artificial Sequence; identical to SEQ ID NO: 939
  Description of Artificial Sequence: Synthetic polypeptide

SEQ ID NO: 1112 - protein, 231 aa, Artificial Sequence; identical to SEQ ID NO: 943
  Description of Artificial Sequence: Synthetic polypeptide

SEQ ID NO: 1113 - protein, 329 aa, Artificial Sequence; identical to SEQ ID NO: 945
  Description of Artificial Sequence: Synthetic polypeptide

SEQ ID NO: 1114 - protein, 231 aa, Artificial Sequence; identical to SEQ ID NO: 943
  Description of Artificial Sequence: Synthetic polypeptide

SEQ ID NO: 1115 - protein, 330 aa, Artificial Sequence; identical to SEQ ID NO: 948
  Description of Artificial Sequence: Synthetic polypeptide

SEQ ID NO: 1116 - protein, 231 aa, Artificial Sequence; identical to SEQ ID NO: 949
  Description of Artificial Sequence: Synthetic polypeptide

SEQ ID NO: 1117 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1118 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1119 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1120 - protein, 231 aa, Artificial Sequence; identical to SEQ ID NO: 1118
  Description of Artificial Sequence: Synthetic polypeptide

SEQ ID NO: 1121 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1122 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1123 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSKLTVDKSRWEEGDVFSCSVMHEALHNHYTQKSLSLSLGK

SEQ ID NO: 1124 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 1125 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 1126 - protein, 228 aa, Artificial Sequence
  Description of Artificial Sequence: Synthetic polypeptide
ERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1127 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 1128 - protein, 228 aa, Artificial Sequence
  Description of Artificial Sequence: Synthetic polypeptide
ERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1129 - protein, 329 aa, Artificial Sequence; identical to SEQ ID NO: 939
  Description of Artificial Sequence: Synthetic polypeptide

SEQ ID NO: 1130 - protein, 329 aa, Artificial Sequence; identical to SEQ ID NO: 952
  Description of Artificial Sequence: Synthetic polypeptide

SEQ ID NO: 1131 - protein, 107 aa, Artificial Sequence [sequence omitted]

SEQ ID NO: 1132 - protein, 329 aa, Artificial Sequence; identical to SEQ ID NO: 939
  Description of Artificial Sequence: Synthetic polypeptide

SEQ ID NO: 1133 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1134 - protein, 329 aa, Artificial Sequence; identical to SEQ ID NO: 1119
  Description of Artificial Sequence: Synthetic polypeptide

SEQ ID NO: 1135 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1136 - protein, 329 aa, Artificial Sequence; identical to SEQ ID NO: 1121
  Description of Artificial Sequence: Synthetic polypeptide

SEQ ID NO: 1137 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1138 - protein, 327 aa, Artificial Sequence; identical to SEQ ID NO: 1123
  Description of Artificial Sequence: Synthetic polypeptide

SEQ ID NO: 1139 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 1140 - protein, 326 aa, Artificial Sequence; identical to SEQ ID NO: 1125
  Description of Artificial Sequence: Synthetic polypeptide

SEQ ID NO: 1141 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1142 - protein, 326 aa, Artificial Sequence; identical to SEQ ID NO: 1127
  Description of Artificial Sequence: Synthetic polypeptide

SEQ ID NO: 1143 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

What is claimed is:

1. A heterodimeric antibody comprising:
   a) a first heavy chain comprising the amino acid sequence of SEQ ID NO: 1080;
   b) a second heavy chain comprising the amino acid sequence of SEQ ID NO: 1070; and
   c) a light chain comprising the amino acid sequence of SEQ ID NO: 1075.

2. A nucleic acid composition comprising:
   a) a first nucleic acid encoding said first heavy chain of claim 1;
   b) a second nucleic acid encoding said second heavy chain of claim 1; and
   c) a third nucleic acid encoding said light chain of claim 1.

3. An expression vector composition comprising:
   a) a first expression vector comprising said first nucleic acid of claim 2;
   b) a second expression vector comprising said second nucleic acid of claim 2; and
   c) a third expression vector comprising said third nucleic acid of claim 2.

4. A host cell comprising said expression vector composition of claim 3.

* * * * *